US010501733B2

(12) United States Patent
King et al.

(10) Patent No.: US 10,501,733 B2
(45) Date of Patent: Dec. 10, 2019

(54) POLYPEPTIDE ASSEMBLIES AND METHODS FOR THE PRODUCTION THEREOF

(71) Applicants: UNIVERSITY OF WASHINGTON, Seattle, WA (US); UNIVERSITY OF UTAH, Salt Lake City, UT (US)

(72) Inventors: Neil King, Seattle, WA (US); Wesley Sundquist, Salt Lake City, UT (US); Joerg Votteler, Salt Lake City, UT (US); Yang Hsia, Seattle, WA (US); David Baker, Seattle, WA (US); Jacob Bale, Seattle, WA (US); Marc Lajoie, Seattle, WA (US); Gabriel Butterfield, Seattle, WA (US); Elizabeth Gray, Seattle, WA (US); Daniel Stetson, Seattle, WA (US)

(73) Assignees: University of Washington, Seattle, WA (US); University of Utah Research Foundation, Salt Lake City, UT (US)

(*) Notice: Subject to any disclaimer, the term of this patent is extended or adjusted under 35 U.S.C. 154(b) by 0 days.

(21) Appl. No.: 15/541,201

(22) PCT Filed: Feb. 29, 2016

(86) PCT No.: PCT/US2016/020090
§ 371 (c)(1),
(2) Date: Jun. 30, 2017

(87) PCT Pub. No.: WO2016/138525
PCT Pub. Date: Sep. 1, 2016

(65) Prior Publication Data
US 2018/0030429 A1    Feb. 1, 2018

Related U.S. Application Data

(60) Provisional application No. 62/126,331, filed on Feb. 27, 2015.

(51) Int. Cl.
*C12N 9/88* (2006.01)
*C07K 14/00* (2006.01)
*C07K 14/435* (2006.01)

(52) U.S. Cl.
CPC ............ *C12N 9/88* (2013.01); *C07K 14/00* (2013.01); *C07K 14/435* (2013.01); *C12Y 401/02014* (2013.01); *C07K 2319/03* (2013.01); *C07K 2319/06* (2013.01); *C07K 2319/735* (2013.01)

(58) Field of Classification Search
CPC .................. C12N 9/88; C12Y 401/02014
See application file for complete search history.

(56) References Cited

U.S. PATENT DOCUMENTS

| 9,314,557 B2 | 4/2016 | Ricci et al. |
| 2009/0246142 A1 | 10/2009 | Bhatia et al. |
| 2011/0200560 A1 | 8/2011 | Zhang |
| 2012/0321653 A1* | 12/2012 | Mamoun ............. C12N 15/625 424/186.1 |
| 2013/0251502 A1 | 9/2013 | Ketcham et al. |
| 2013/0274441 A1 | 10/2013 | Baker et al. |
| 2015/0356240 A1 | 12/2015 | Baker et al. |

FOREIGN PATENT DOCUMENTS

| WO | 2009/109428 A2 | 9/2009 |
| WO | 2014/124301 A1 | 8/2014 |
| WO | 2014/152751 A1 | 9/2014 |

OTHER PUBLICATIONS

BioAfrica, 2019, MA-P17 Matrix Protein, on the web at bioafrica.net/proteomics/GAG-MAprot.html.*
Hurley, James H. et al., "Membrane budding and scission by the ESCRT machinery: it's all in the neck" Nature Reviews Molecular Cell Biology (2010) vol. 11, pp. 556-566.
The International Search Report (ISR) for PCT/US2016/020090 dated Jun. 10, 2016, pp. 1-4.
The Written Opinion of the International Searching Authority for PCT/US2016/020090 dated Jun. 10, 2016, pp. 1-5.
Albritton, et al., "Observers for Sensorless Control of Industrial Magnetic Bearings," IEEE, pp. 973-978, 1995.
Hoshi, et al., "Magnetically Suspended Centrifugal Blood Pump With a Radial Magnetic Driver," ASAIO Journal, 2005.
Hoshi, et al., "Third-generation Blood Pumps With Mechanical Noncontact Magnetic Bearings," Artificial Organs, vol. 30, No. 5, pp. 324-338, 2006.
Li, et al. "Design Principles for Multicuhannel Fringing Electric Field Sensors," Li, IEEE Sensors Journal, vol. 6, No. 2, 2006.
Qian, et al., "Study on stable equilibrium of levitated impeller in rotary pump with passive magnetic bearings," Journal of Medical Engineering & Technology, vol. 30, No. 2, pp. 78-82, 2006.

(Continued)

*Primary Examiner* — Karen Cochrane Carlson
(74) *Attorney, Agent, or Firm* — McDonnell Boehnen Hubert & Berghoff LLP

(57) ABSTRACT

The application discloses multimeric assemblies including multiple oligomeric substructures, where each oligomeric substructure includes multiple proteins that self-interact around at least one axis of rotational symmetry, where each protein includes one or more polypeptide-polypeptide interface ("O interface"); and one or more polypeptide domain that is capable of effecting membrane scission and release of an enveloped multimeric assembly from a cell by recruiting the ESCRT machinery to the site of budding by binding to one or more proteins in the eukaryotic ESCRT complex ("L domain"); and where the multimeric assembly includes one or more subunits comprising one or more polypeptide domain that is capable of interacting with a lipid bilayer ("M domain"), as well as membrane-enveloped versions of the multimeric assemblies.

25 Claims, 13 Drawing Sheets

Specification includes a Sequence Listing.

(56) References Cited

OTHER PUBLICATIONS

Schuhmann, et al., "Improving Operational Performance of Active Magnetic Bearings Using Kalman Filter and State Feedback Control," IEEE transactions on industrial electronics, vol. 59, No. 2, pp. 821-2019, 2012.

Grenfell, et al., "Vaccine Self-Assembling Immune Matrix Is a New Delivery Platform That Enhances Immune Responses to Recombinant HBsAg in Mice," Clin Vaccine Immunol. Mar. 2015;22(3):336-43. Epub Jan. 21, 2015.

Tagalakis, et al., "Multifunctional, self-assembling anionic peptide-lipid nanocomplexes for targeted siRNA delivery," Biomaterials. Sep. 2014;35(29):8406-15. Epub Jun. 28, 2014.

Zhang, et al., "Unfolding a molecular trefoil derived from a zwitterionic metallopeptide to form self-assembled nanostructures," Nat Commun. Feb. 19, 2015;6:6165.

Doug Huseby et al., "Assembly of Human Immunodeficiency Virus Precursor Gag Proteins", The Journal of Biological Chemistry, May 6, 2005, vol. 280, No. 18, pp. 17664-17670.†

Wenjun Zhou et al., "Identification of a Membrane-Binding Domain within the Amino-Terminal Region of Human Immunodeficiency Virus Type 1 Gag Protein Which Interacts with Acidic Phospholipids", Journal of Virology, Apr. 1994, vol. 68, No. 4, pp. 2556-2569.†

Bettina Strack et al., "AIP1/ALIX Is a Binding Partner for HIV-1 p6 and EIAV p9 Functioning in Virus Budding", Cell, Sep. 2003, vol. 114, No. 6, pp. 689-699.†

Vincent Dussupt et al., "The Nucleocapsid Region of HIV-1 Gag Cooperates with the PTAP and LYPXnL Late Domains to Recruit the Cellular Machinery Necessary for Viral Budding", PLoS Pathogens, Mar. 2009, vol. 5, No. 3, pp. 1-17, e1000339.†

\* cited by examiner
† cited by third party

POLYPEPTIDE ASSEMBLIES AND METHODS FOR THE PRODUCTION THEREOF

CROSS REFERENCE

This application is a U.S. national phase of International Application No. PCT/US2016/020090, filed on Feb. 29, 2016, which claims priority to U.S. Provisional Application No. 62/126,331, filed Feb. 27, 2015, both of which are incorporated by reference herein in their entirety.

FEDERAL FUNDING STATEMENT

This invention was made with government support under W911NF1410162 awarded by the Defense Advanced Research Projects Agency (DARPA), and under RO1 AI 051174 and P50 GM082545 awarded by the National Institutes of Health. The government has certain rights in the invention.

SEQUENCE LISTING

Please incorporate the copy of the sequence listing, entitled "15-280-PCT_SeqListAmend-5-29-19.txt" prepared May 29, 2019 and 358,505 bytes in size, submitted herewith, into the specification.

SUMMARY OF THE INVENTION

In one aspect, the invention provides multimeric assemblies, comprising a plurality of oligomeric substructures, wherein each oligomeric substructure comprises a plurality of proteins that self-interact around at least one axis of rotational symmetry, wherein each protein comprises:

(a) one or more polypeptide-polypeptide interface ("O interface");

(b) one or more polypeptide domain that is capable of effecting membrane scission and release of an enveloped multimeric assembly from a cell by recruiting the ESCRT machinery to the site of budding by binding directly or indirectly to one or more ESCRT or ESCRT-associated proteins ("L domain");

wherein the multimeric assembly comprises one or more polypeptide domain that is capable of interacting with a lipid bilayer ("M domain");

wherein the M domain, L domain, and O interface are not each present in a single naturally occurring protein, wherein the plurality of oligomeric substructures interact with each other at the one or more O interfaces.

In various embodiments, each oligomeric structure comprises one or more M domain, or wherein each protein comprises one or more M domain. In another embodiment, the one or more O interfaces orient the plurality of oligomeric substructures such that their symmetry axes are aligned with symmetry axes of the same kind in a designated mathematical symmetry group. In a further embodiment, the one or more O interfaces of each oligomeric substructure are identical. In another embodiment, the one or more M domains are capable of non-covalently interacting with a lipid bilayer. In a further embodiment, the one or more L domains are capable of non-covalently interacting with one or more proteins in the ESCRT pathway. In one embodiment, the one or more M domains comprise a polypeptide having an acylation motif (including but not limited to N-terminal myristoylation motifs, palmitoylation motifs, farnesylation motifs, and geranylgeranylation motifs), a polar headgroup-binding domain (including but not limited to those described herein and in the attached appendices), envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55, CD59, and transmembrane protein domains. In a further embodiment, the one or more M domains are selected from the group consisting of SEQ ID NOS: 52-151 and 280-300. In another embodiment, the one or more O interfaces are non-naturally occurring. In a further embodiment, the one or more O interfaces comprise or consist of the amino acid sequence of SEQ ID NO:1-5, 7-9, 20, or 304. In a still further embodiment, the one or more L domains comprise a linear amino acid sequence motif selected from the group consisting of SEQ ID NOS: 152-197 or 305-306, or overlapping combinations thereof.

In one embodiment, the multimeric assemblies further comprise a packaging moiety. Such packaging moieties may comprise a cysteine residue or a non-canonical amino acid residue on one or more of the L, O, and M domains; a polypeptide that interacts with a cargo of interest, or comprises an amino acid sequence selected from the group consisting of SEQ ID NOS:186 and 198-201.

In a further embodiment, the multimeric assemblies further comprise a cargo interacting with the packaging moiety, or present in the plurality of proteins as a further domain when the cargo is a polypeptide. In one embodiment, the cargo is selected from the group consisting of proteins, nucleic acids, and small organic compounds. In a further embodiment, the cargo may comprise a polypeptide or polynucleotide selected from the group consisting of SEQ ID NOS:202-219. In a still further embodiment, each protein in the plurality of proteins comprises or consists of the amino acid sequence of SEQ ID NOS:227-269.

In another embodiment, the multimeric assembly of any embodiment or combination of embodiments of the invention further comprises a lipid bilayer enveloping the multimeric assembly, wherein one or more of the M domains may be bound to the lipid bilayer. In one embodiment, the assembly further comprises one or more transmembrane protein or membrane-anchored protein embedded in the lipid bilayer. In various non-limiting embodiments, the transmembrane or membrane-anchored protein is selected from the group consisting of the envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55 and CD59. In a further embodiment, the lipid-enveloped assembly comprises a cargo, wherein the cargo is not bound to the multimeric assembly, such as a protein, nucleic acid, lipid, or small molecule.

In another aspect, the invention provides recombinant polypeptides comprising (a) a polypeptide domain that is capable of interacting with a lipid bilayer ("M domain");

(b) a polypeptide-polypeptide interface ("O interface"); and (c) a polypeptide domain that is capable of effecting membrane scission and release of an enveloped multimeric assembly from a cell by recruiting the ESCRT machinery to the site of budding by binding to one or more proteins in the eukaryotic ESCRT complex ("L domain");

wherein the M domain, the L domain, and the O interface are not each present in a single naturally occurring protein.

In one embodiment, the M domain is capable of non-covalently interacting with a lipid bilayer. In another embodiment, the L domain is capable of non-covalently interacting with one or more proteins in the ESCRT machinery or proteins known to recruit the ESCRT machinery to the site of budding by binding to one or more ESCRT proteins directly or indirectly. In a further embodiment, the M domain comprises a polypeptide having an acylation motif (including but not limited to N-terminal myristoylation motifs, palmitoylation motifs, farnesylation motifs, and geranylgeranylation motifs), a polar headgroup-binding domains (including but not limited to the polar headgroup-binding domains disclosed herein and in the attached appendices), envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55, CD59, and transmembrane protein domains. In another embodiment of the polypeptides, M domain comprises the amino acid sequence of SEQ ID NOS:52-151 or 280-300. In a further embodiment of the polypeptides, the O interface comprises a non-natural polypeptide, including but not limited to a polypeptide comprising or consisting of SEQ ID NO:1-5, 7-9, 20, or 304. In another embodiment of the polypeptides, the L domains comprise a linear amino acid sequence motif selected from the group consisting of SEQ ID NOS: 152-197 or 305-306, or overlapping combinations thereof. In a further embodiment, the polypeptides further comprising a packaging moiety, including but not limited to a cysteine residue or a non-canonical amino acid residue on one or more of the L, O, and M domains; a polypeptide that interacts with a cargo of interest, or comprises an amino acid sequence selected from the group consisting of SEQ ID NOS:186 and 198-201.

In a further aspect, the invention provides recombinant polypeptides comprising an amino acid sequence at least 75% identical over its full length to SEQ ID NO:20 or 304, wherein the polypeptide includes at least 1, 2, 3, 4, 5, or more amino acid substitutions compared to SEQ NO:21.

In another aspect, the invention provides recombinant nucleic acid encoding the recombinant polypeptide of any embodiment or combination of embodiment of the invention. In a further aspect, the invention provides recombinant expression vectors comprising the recombinant nucleic acid of any embodiment or combination of embodiments operatively linked to a promoter.

In a further aspect, the invention provides recombinant host cells comprising the recombinant expression vector of any embodiment or combination of embodiments of the invention. In one embodiment, the host cell comprises two or more recombinant vectors including:

(a) a first recombinant expression vector of any embodiment of the invention; and (b) a second recombinant expression vector comprising a recombinant nucleic acid encoding one or more transmembrane proteins or membrane-anchored proteins operatively linked to a promoter. In one embodiment, the second expression vector encodes a transmembrane or membrane-anchored protein is selected from the group consisting of the envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55 and CD59. In a further embodiment, the host cell further comprises a third recombinant expression vector, wherein the third recombinant expression vector comprises a recombinant nucleic acid encoding cyclic GMP-AMP synthase (cGAS) protein operatively linked to a promoter. In a further embodiment, the third recombinant expression vector comprises a recombinant nucleic acid encoding a polypeptide or polynucleotide cargo operatively linked to a promoter.

In another aspect, the invention provides methods for producing a multimeric assembly according to any embodiment or combination of embodiments of the invention, comprising culturing the recombinant host cells of any embodiment or combination of embodiments of the invention under conditions suitable to promote expression of the encoded recombinant polypeptide, wherein the recombinant host cell is a eukaryotic host cell, wherein expression of the encoded recombinant polypeptide in the eukaryotic host cell results in (a) production of the multimeric assembly, and (b) interaction of one or more of the M domains of the multimeric assembly with the lipid bilayer membrane of the eukaryotic host cell, and wherein attachment of the one or more M domains of the multimeric assembly to the lipid bilayer membrane of the eukaryotic host cell results in the multimeric assembly being enveloped by eukaryotic host-derived lipid bilayer membrane, followed by recruitment of the ESCRT machinery to the site of budding by the L domains of the multimeric assembly, which releases the enveloped multimeric assembly from the eukaryotic host cell by catalyzing membrane scission.

DETAILED DESCRIPTION OF THE INVENTION

All references cited are herein incorporated by reference in their entirety. As used herein, the singular forms "a", "an" and "the" include plural referents unless the context clearly dictates otherwise. "And" as used herein is interchangeably used with "or" unless expressly stated otherwise.

All embodiments of any aspect of the invention can be used in combination, unless the context clearly dictates otherwise.

Unless the context clearly requires otherwise, throughout the description and the claims, the words 'comprise', 'comprising', and the like are to be construed in an inclusive sense as opposed to an exclusive or exhaustive sense; that is to say, in the sense of "including, but not limited to". Words using the singular or plural number also include the plural and singular number, respectively. Additionally, the words "herein," "above," and "below" and words of similar import, when used in this application, shall refer to this application as a whole and not to any particular portions of the application.

The description of embodiments of the disclosure is not intended to be exhaustive or to limit the disclosure to the precise form disclosed. While the specific embodiments of, and examples for, the disclosure are described herein for illustrative purposes, various equivalent modifications are possible within the scope of the disclosure, as those skilled in the relevant art will recognize.

In a first aspect, the present invention provides multimeric assemblies, comprising a plurality of oligomeric substructures, wherein each oligomeric substructure comprises a plurality of proteins that self-interact around at least one axis of rotational symmetry, wherein each protein comprises:

(a) one or more polypeptide-polypeptide interface ("O interface");

(b) one or more polypeptide domain that is capable of effecting membrane scission and release of an enveloped multimeric assembly from a cell by recruiting the ESCRT machinery to the site of budding by binding directly or indirectly to one or more ESCRT or ESCRT-associated proteins ("L domain");

wherein the multimeric assembly comprises one or more polypeptide domain that is capable of interacting with a lipid bilayer ("M domain");

and wherein the M domain, L domain, and O interface are not each present in a single naturally occurring protein, wherein the plurality of oligomeric substructures interact with each other at the one or more O interfaces.

Figure 1:
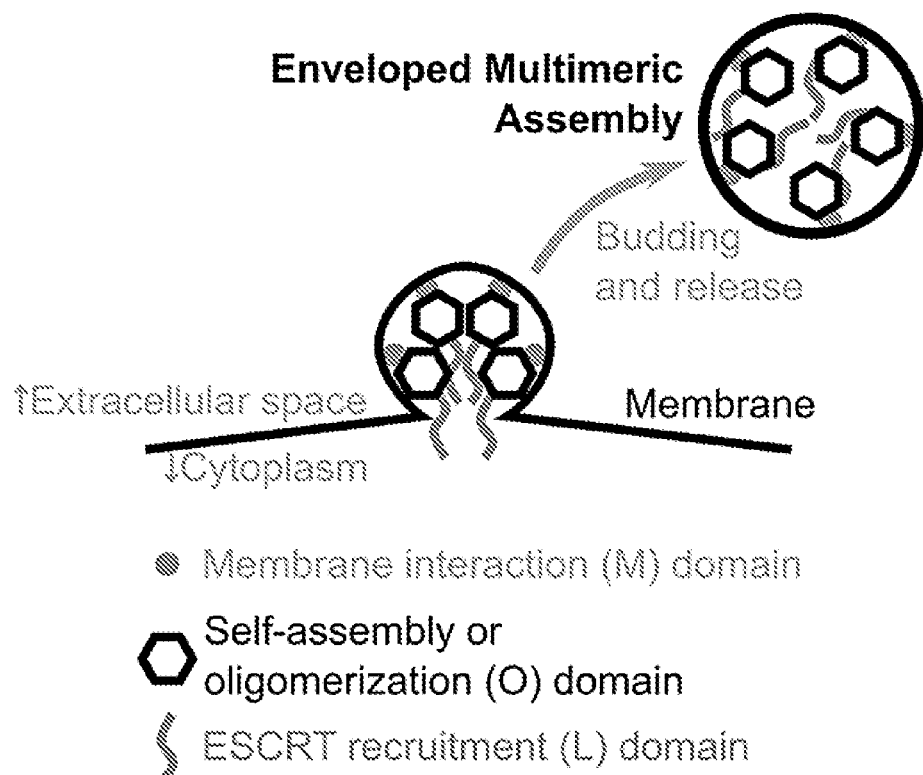
FIG. 1. Schematic of enveloped multimeric assembly budding and release. Multimeric assemblies of the invention, comprising oligomeric substructure that each comprise a plurality of proteins having M, O, and L domains, are shown forming a membrane-enveloped bud at a cellular membrane. Recruitment of the host cell ESCRT machinery to the site of budding results in fission of the membrane neck that connects the budding membrane to the cellular membrane, thereby releasing the enveloped multimeric assembly from the cell.

FIG. 1 shows an exemplary embodiment of a multimeric assembly of this first aspect of the invention.

The multimeric assemblies of each aspect of the invention can be used for any suitable purpose, including but not limited to delivery vehicles or vaccines, as the multimeric assemblies can encapsulate molecules of interest and/or the proteins can be modified to bind to molecules of interest (diagnostics, therapeutics, antigens, adjuvants, nucleic acids, detectable molecules for imaging and other applications, etc.).

The multimeric assemblies of the invention are synthetic, in that they are not naturally occurring. The proteins that make up the multimeric assembly are non-naturally occurring proteins that can be produced by any suitable means, including recombinant production or chemical synthesis. In this first aspect, each member of the plurality of proteins is identical to each other. There are no specific primary amino acid sequence requirements for the proteins. As described in detail herein, the inventors disclose methods for designing the multimeric assemblies of the invention, where the multimeric assemblies are not dependent on specific primary amino acid sequences of the protein that makes up the oligomeric substructures that interact to form the multimeric assemblies of the invention. As will be understood by those of skill in the art, the design methods of the invention can produce a wide variety of multimeric assemblies made of a wide variety of subunit proteins, and the methods are in no way limited to the subunit proteins disclosed herein.

As used herein, a "plurality" means at least two; in various embodiments, there are at least 2, 3, 4, 5, 6 or more proteins in the first oligomeric substructure. In one exemplary embodiment, the oligomeric substructure comprises a trimer of the protein.

The proteins of any aspect of the invention may be of any suitable length for a given purpose of the resulting multimeric assemblies. In one embodiment, the protein is typically between 30-250 amino acids in length. In various further embodiments, the protein is between 30-225, 30-200, 30-175, 50-250, 50-225, 50-200, 50-175, 75-250, 75-225, 75-200, 75-175, 100-250, 100-225, 100-200, 100-175, 125-250, 125-225, 125-200, 125-175, 150-250, 150-225, 150-200, and 150-175 amino acids in length.

The plurality of proteins self-interact to form a oligomeric substructure, where each oligomeric substructure may comprise at least one axis of rotational symmetry. As will be understood by those of skill in the art, the self-interaction is a non-covalent protein-protein interaction. Any suitable non-covalent interaction(s) can drive self-interaction of the proteins to form the oligomeric substructure, including but not limited to one or more of electrostatic interactions, π-effects, van der Waals forces, hydrogen bonding, and hydrophobic effects. The self-interaction in the oligomeric substructure may be natural or synthetic in origin; that is, the synthetic proteins making up the multimeric assemblies of the invention may be synthetic variations of natural proteins that self-interact to form oligomeric substructures, or they may be fully synthetic proteins that have no amino acid sequence relationships to known natural proteins.

As used herein, "at least one axis of rotational symmetry" means at least one axis of symmetry around which the oligomeric substructure can be rotated without changing the appearance of the substructure. In one embodiment, the oligomeric substructure has cyclic symmetry, meaning rotation about a single axis (for example, a three-fold axis in the case of a trimeric protein; generally, oligomeric substructures with n subunits and cyclic symmetry will have n-fold rotational symmetry, sometimes denoted as $C_n$ symmetry). In other embodiments, the oligomeric substructure possesses symmetries comprising multiple rotational symmetry axes, including but not limited to dihedral symmetry (cyclic symmetry plus an orthogonal two-fold rotational axis) and the cubic point group symmetries including tetrahedral, octahedral, and icosahedral point group symmetry (multiple kinds of rotational axes). In one non-limiting embodiment, the oligomeric substructure comprises a dimer, trimer, tetramer, or pentamer of the protein. In a further non-limiting embodiment, the oligomeric substructure comprises a trimeric protein.

In the multimeric assemblies of the invention, there are at least two identical copies of the oligomeric substructure. In general, the number of copies of the oligomeric substructure is dictated by the number of symmetry axes in the designated mathematical symmetry group of the multimeric assembly that matches the symmetry axes in each oligomeric substructure. This relationship arises from the requirement that the symmetry axes of each copy of the oligomeric substructure must be aligned to symmetry axes of the same kind in the multimeric assembly. By way of non-limiting example, a multimeric assembly with tetrahedral point group symmetry can comprise exactly four copies of a trimeric substructure aligned along the exactly four three-fold symmetry axes passing through the center and vertices of a tetrahedron. In general, although every copy of the oligomeric substructure may have its symmetry axes aligned to symmetry axes of the same kind in the multimeric assembly, not all symmetry axes in the multimeric assembly must have an oligomeric building block aligned to them. By way of non-limiting example, we can consider a multimeric assembly with icosahedral point group symmetry comprising multiple copies of the oligomeric substructure. There are 30 two-fold, 20 three-fold, and 12 five-fold rotational symmetry axes in icosahedral point group symmetry. The multimeric assemblies of the invention may be those in which the oligomeric substructures are aligned along all instances of one type of symmetry axes in a designated mathematical symmetry group. Therefore, the multimeric assemblies in this non-limiting example could include icosahedral nanostructures comprising 30 dimeric substructures, or 12 pentameric substructures, or 20 trimeric substructures. In each case, two of the three types of symmetry axes are left unoccupied by oligomeric substructures.

The interaction between the oligomeric substructures is a non-natural (e.g., not an interaction seen in a naturally occurring protein multimer), non-covalent interaction at the 0 interface; this can comprise any suitable non-covalent interaction(s), including but not limited to one or more of electrostatic interactions, π-effects, van der Waals forces, hydrogen bonding, and hydrophobic effects. The interaction may occur at multiple identical (i.e., symmetrically related) O interfaces between the oligomeric substructures, wherein the 0 interfaces can be continuous or discontinuous. This symmetric repetition of the O interfaces between the oligomeric substructures results from the overall symmetry of the multimeric assemblies; because each protein is in a symmetrically equivalent position in the multimeric assembly, the interactions between them are also symmetrically equivalent.

Non-covalent interactions between the oligomeric substructures may orient the substructures such that their symmetry axes are aligned with symmetry axes of the same kind in a designated mathematical symmetry group as described above. This feature provides for the formation of regular, defined multimeric assemblies, as opposed to irregular or imprecisely defined structures or aggregates. Several structural features of the non-covalent interactions between the oligomeric substructures may help to provide a specific orientation between substructures. Generally, large interfaces that are complementary both chemically and geometrically and comprise many individually weak atomic interactions tend to provide highly specific orientations between protein molecules. In one embodiment of the subject invention, therefore, each symmetrically repeated instance of the O interface between the oligomeric substructures may bury between 1000-2000 $Å^2$ of solvent-accessible surface area (SASA) on the combined oligomeric substructures. SASA is a standard measurement of the surface area of molecules commonly used by those skilled in the art; many computer programs exist that can calculate both SASA and the change in SASA upon burial of a given interface for a given protein structure. A commonly used measure of the geometrical complementarity of protein-protein interfaces is the Shape Complementarity ($S_c$) value of Lawrence and Colman (*J. Mol. Biol.* 234:946-50 (1993)). In a further embodiment, each symmetrically repeated O interface between the oligomeric substructures may have an $S_c$ value between 0.5-0.8. Finally, in order to provide a specific orientation between the oligomeric substructures, in many embodiments the O interface between them may be formed by relatively rigid portions of each of the protein. This feature ensures that flexibility within each protein molecule does not lead to imprecisely defined orientations between the oligomeric substructures. Secondary structures in proteins, that is alpha helices and beta strands, generally make a large number of atomic interactions with the rest of the protein structure and therefore occupy relatively rigidly fixed positions. Therefore, in one embodiment, at least 50% of the atomic contacts comprising each symmetrically repeated, 0 interface between the oligomeric substructures are formed from amino acid residues residing in elements of alpha helix and/or beta strand secondary structure.

In a second aspect, the invention provides multimeric assemblies, comprising a plurality of subunit structures, wherein each subunit structure comprises a first protein that self-interacts to form a first oligomeric substructure comprising at least one axis of rotational symmetry, and a second protein that self-interacts to form a second oligomeric substructure comprising at least one axis of rotational symmetry, wherein each first protein and each second protein comprise one or more O interfaces that interact with each other, and wherein at least one of the first protein or the second protein comprises:

(a) one or more polypeptide domains that are capable of interacting with a lipid bilayer ("M domain"); and (c) one or more polypeptide domains that are capable of effecting membrane scission and release of an enveloped multimeric assembly from a cell by recruiting the ESCRT machinery to the site of budding by binding to one or more ESCRT proteins ("L domain");

wherein the M and L domains and O interfaces are not each present in a single naturally occurring protein, wherein the O interfaces in the first protein bind to the 0 interfaces present in the second protein to form a subunit structure, and wherein each subunit structure binds to other subunit structures through self-interactions within the first and second oligomeric substructures to form the multimeric assembly.

In this aspect, each of the first protein and the second protein comprise an O interface, while the M domain and the L domain may each independently be present only in the first protein, only in the second protein, or both. For example, the M domain may be part of the first protein and the L domain may be part of the second protein; in this embodiment, the first oligomeric substructure will include multiple copies of the M domain but no copies of the L domain, while the second oligomeric substructure will include multiple copies of the L domain but no copies of the M domain. A resulting subunit structure comprising both the first and second oligomeric domains will then include both the M domains and the L domains. In other embodiments, the first and second protein may both include one or more M domains and one or more L domains.

In this aspect, two different proteins (the first protein and the second protein) each self-interact to form a first oligomeric substructure and a second oligomeric substructure, respectively. The O interfaces present in the first and second oligomeric substructures non-covalently interact to form the subunit structures, which then bind to other subunit structures to form the multimeric assemblies of the invention. The first protein and the second protein are different.

In various embodiments, there are at least 2, 3, 4, 5, 6 or more subunit structures in the multimeric assembly. The first and second proteins of may be of any suitable length for a given purpose of forming oligomeric substructures. In one embodiment, the first and second proteins are typically between 30-250 amino acids in length. In various further embodiments, the first and second proteins are between 30-225, 30-200, 30-175, 50-250, 50-225, 50-200, 50-175, 75-250, 75-225, 75-200, 75-175, 100-250, 100-225, 100-200, 100-175, 125-250, 125-225, 125-200, 125-175, 150-250, 150-225, 150-200, and 150-175 amino acids in length.

The first protein self-interacts to form a first oligomeric substructure and the second protein self-interacts to form a second oligomeric substructure, where each oligomeric substructure may comprises at least one axis of rotational symmetry (as defined above). As will be understood by those of skill in the art, the self-interaction is a non-covalent protein-protein interaction and may comprise any suitable non-covalent interaction(s), as described above. The self-interaction in each of the two different oligomeric substructures may be natural or synthetic in origin; that is, the synthetic proteins making up the multimeric assemblies of the invention may be synthetic variations of natural proteins that self-interact to form multimeric substructures, or they may be fully synthetic proteins that have no amino acid sequence relationships to known natural proteins.

In one embodiment, one or both of the oligomeric substructures have cyclic symmetry, meaning rotation about a single axis (for example, a three-fold axis in the case of a trimeric protein; generally, oligomeric substructures with n subunits and cyclic symmetry will have n-fold rotational symmetry, sometimes denoted as $C_n$ symmetry). In other embodiments, one or both oligomeric substructures possess symmetries comprising multiple rotational symmetry axes, including but not limited to dihedral symmetry (cyclic symmetry plus an orthogonal two-fold rotational axis) and the cubic point group symmetries including tetrahedral, octahedral, and icosahedral point group symmetry (multiple kinds of rotational axes). The first oligomeric substructure and the second oligomeric substructure may comprise the same or different rotational symmetry properties. In one non-limiting embodiment, the first oligomeric substructure comprises a dimer, trimer, tetramer, or pentamer of the first protein, and wherein the second oligomeric substructure comprises a dimer or trimer of the second protein. In a further non-limiting embodiment, the first oligomeric protein comprises a trimeric protein, and the second oligomeric protein comprises a dimeric protein. In another non-limiting embodiment, the first oligomeric protein comprises a trimeric protein, and the second oligomeric protein comprises a different trimeric protein.

In the multimeric assemblies of the invention, there are at least two identical copies of the first oligomeric substructure and at least two identical copies of the second oligomeric substructure in the assembly. In one embodiment, the number of copies of each of the first and second oligomeric substructures may be dictated by the number of symmetry axes in the designated mathematical symmetry group of the assembly that match the symmetry axes in each oligomeric substructure. This relationship arises from the preference that the symmetry axes of each copy of each oligomeric substructure are aligned to symmetry axes of the same kind in the assembly. By way of non-limiting example, an assembly with tetrahedral point group symmetry may comprise exactly four copies of a first trimeric substructure aligned along the exactly four three-fold symmetry axes passing through the center and vertices of a tetrahedron. Likewise, the same non-limiting example tetrahedral assembly can comprise six (but not five, seven, or any other number) copies of a dimeric substructure aligned along the six two-fold symmetry axes passing through the center and edges of the tetrahedron. In general, although every copy of each oligomeric substructure may have its symmetry axes aligned to symmetry axes of the same kind in the assembly, not all symmetry axes in the assembly must have a multimeric building block aligned to them. By way of non-limiting example, we can consider an assembly with icosahedral point group symmetry comprising multiple copies of each of a first oligomeric substructure and a second oligomeric substructure. There are 30 two-fold, 20 three-fold, and 12 five-fold rotational symmetry axes in icosahedral point group symmetry. The assemblies of this aspect of the invention are those in which two different oligomeric substructures are aligned along all instances of two types of symmetry axes in a designated mathematical symmetry group. Therefore, the assemblies in this non-limiting example could include icosahedral assemblies comprising 30 dimeric substructures and 20 trimeric substructures, or 30 dimeric substructures and 12 pentameric substructures, or 20 trimeric substructures and 12 pentameric substructures. In each case, one of the three types of symmetry axes is left unoccupied by oligomeric substructures.

The interaction between the first and second oligomeric substructures via the 0 interface is a non-natural (e.g., not an interaction seen in a naturally occurring protein multimer), non-covalent interaction; this can comprise any suitable non-covalent interaction(s), as discussed above. The interaction may occur at multiple identical 0 interfaces (symmetrical) between the first and second oligomeric substructures, wherein the O interfaces can be continuous or discontinuous. This symmetric repetition of the 0 interfaces between the first and second oligomeric substructures results from the overall symmetry of the subject assemblies; because each protein molecule of each of the first and second oligomeric substructures may be in a symmetrically equivalent position in the assembly, the interactions between them are also symmetrically equivalent.

Non-covalent interactions between the first oligomeric substructures and the second oligomeric substructures orient the substructures such that their symmetry axes are aligned with symmetry axes of the same kind in a designated mathematical symmetry group as described above. This feature provides for the formation of regular, defined assemblies, as opposed to irregular or imprecisely defined structures or aggregates. Several structural features of the non-covalent interactions between the first oligomeric substructures and the second oligomeric substructures help to provide a specific orientation between substructures. Generally, large interfaces that are complementary both chemically and geometrically and comprise many individually weak atomic interactions tend to provide highly specific orientations between protein molecules. In one embodiment of the subject invention, therefore, each symmetrically repeated instance of the O interface between the first oligomeric substructure and the second oligomeric substructure may bury between 1000-2000 $Å^2$ of solvent-accessible surface area (SASA) on the first oligomeric substructure and the second oligomeric substructure combined. In a further embodiment, each symmetrically repeated O interface between the first oligomeric substructure and the second oligomeric substructure has an $S_c$ value between 0.5-0.8. Finally, in order to provide a specific orientation between the first oligomeric substructures and the second oligomeric substructures, in many embodiments the O interface between them may be formed by relatively rigid portions of each of the oligomeric substructures. This feature ensures that flexibility within each protein molecule does not lead to imprecisely defined orientations between the first and second oligomeric substructures. In another embodiment, at least 50% of the atomic contacts comprising each symmetrically repeated, O interface between the first oligomeric substructure and the second oligomeric substructure are formed from amino acid residues residing in elements of alpha helix and/or beta strand secondary structure.

The multimeric assemblies of all aspects of the invention are capable of forming a variety of different structural classes based on the designated mathematical symmetry group of each assembly. As the teachings above indicate, the assemblies comprise multiple copies of substructures that interact at one or more O interfaces that orient the substructures such that their symmetry axes may align with symmetry axes of the same kind in a designated mathematical symmetry group. There are many symmetry groups that comprise multiple types of symmetry axes, including but not limited to dihedral symmetries, cubic point group symmetries, line or helical symmetries, plane or layer symmetries, and space group symmetries. Each individual assembly possesses a single, mathematically defined symmetry that results from the interface between the substructures orienting them such that their symmetry axes align to those in a designated mathematically symmetry group. Individual assemblies possessing different symmetries may find use in different applications; for instance, assemblies possessing cubic point group symmetries may form hollow shell- or cage-like structures that could be useful, for example, for packaging or encapsulating molecules of interest, while assemblies possessing plane group symmetries will tend to form regularly repeating two-dimensional protein layers that could be used, for example, to array molecules, nanostructures, or other functional elements of interest at regular intervals.

In one embodiment, the mathematical symmetry group is selected from the group consisting of tetrahedral point group symmetry, octahedral point group symmetry, and icosahedral point group symmetry.

As used herein, the O interface is any polypeptide region (contiguous or non-contiguous) that is capable of driving self-assembly of the proteins and/or oligomeric substructures of the assemblies of the present invention via non-covalent interactions. The 0 interfaces are non-natural protein interfaces, in that they are designed and are not naturally occurring. The O interfaces may utilize any suitable non-covalent interaction(s) to drive self-interaction of the proteins and/or oligomeric substructures, including but not limited to one or more of electrostatic interactions, π-effects, van der Waals forces, hydrogen bonding, and hydrophobic effects. In the first aspect, where the oligomeric substructures are formed from a single protein, the one or more O interfaces are identical. In the second aspect, where first and second proteins self-interact to form oligomeric assemblies, which interact via the 0 interfaces to form subunit structures, each O interface may be the same or different.

Based on the disclosure herein, it is well within the level of those of skill in the art to identify O interfaces suitable for use in producing the multimeric assemblies of the invention. In one embodiment, a suitable O interface can be identified as follows:

As described elsewhere in this application, an O interface for use in the present invention can be any polypeptide region (contiguous or non-contiguous) that is capable of driving self-assembly of the proteins and/or oligomeric substructures of the assemblies of the present invention via non-covalent interactions. The O interfaces are non-natural protein interfaces, in that they are designed and are not naturally occurring. As will be known to those of skill in the art, an O interface can be demonstrated to perform the function of driving self-assembly using a variety of standard biochemical and biophysical techniques for evaluating the apparent size of multi-subunit protein assemblies. Such assays include but are not limited to native (non-denaturing) polyacrylamide gel electrophoresis, size exclusion chromatography, multi-angle light scattering, dynamic light scattering, analytical ultracentrifugation, small-angle X-ray scattering, visualization by electron microscopy or cryo-electron microscopy, atomic force microscopy, and high-resolution structure determination by X-ray crystallography. In the case of multimeric assemblies that comprise a first oligomeric protein substructure and a second oligomeric protein substructure, techniques commonly used to identify interactions between two different proteins can additionally be used to demonstrate the ability of an O interface to drive self-assembly of the first and second proteins. Such techniques include but are not limited to co-precipitation or co-purification of the two proteins, isothermal titration calorimetry, fluorescence resonance energy transfer-based techniques, and fluorescence anisotropy. In all cases, disruption of the amino acid residues comprising the non-natural protein-protein interface within the O interface by mutation, or deletion of the O interface, can provide valuable controls for evaluating the function of the O interface.

In various further embodiments, the O interface is present (contiguously or non-contiguously) in a polypeptide comprising or consisting of one of the following amino acid sequences, which are particularly useful in generating the assemblies of the first aspect of the invention:

| SEQ ID NO: 1 | | | |
|---|---|---|---|
| AA1 | M or absent | AA2 | ANY |
| AA3 | ANY | AA4 | A |
| AA5 | I | AA6 | G |
| AA7 | I | AA8 | L |
| AA9 | E | AA10 | L |
| AA11 | ANY | AA12 | S |
| AA13 | I | AA14 | A |
| AA15 | A | AA16 | G |
| AA17 | M | AA18 | E |
| AA19 | L | AA20 | G |
| AA21 | D | AA22 | A |
| AA23 | M | AA24 | L |
| AA25 | ANY | AA26 | S |
| AA27 | A | AA28 | ANY |
| AA29 | V | AA30 | ANY |
| AA31 | L | AA32 | L |
| AA33 | V | AA34 | S |
| AA35 | ANY | AA36 | T |
| AA37 | I | AA38 | ANY |
| AA39 | ANY | AA40 | G |
| AA41 | ANY | AA42 | F |
| AA43 | L | AA44 | L |
| AA45 | M | AA46 | L |
| AA47 | G | AA48 | G |
| AA49 | ANY | AA50 | ANY |
| AA51 | G | AA52 | A |
| AA53 | I | AA54 | Q |
| AA55 | ANY | AA56 | A |
| AA57 | I | AA58 | E |
| AA59 | T | AA60 | G |
| AA61 | T | AA62 | S |
| AA63 | Q | AA64 | A |
| AA65 | G | AA66 | E |
| AA67 | L | AA68 | ANY |
| AA69 | ANY | AA70 | ANY |
| AA71 | S | AA72 | ANY |
| AA73 | V | AA74 | L |
| AA75 | ANY | AA76 | ANY |
| AA77 | I | AA78 | ANY |
| AA79 | ANY | AA80 | S |
| AA81 | V | AA82 | L |
| AA83 | ANY | AA84 | A |
| AA85 | I | AA86 | ANY |
| AA87 | ANY | AA88 | ANY |
| AA89 | N | AA90 | ANY |
| AA91 | V | AA92 | ANY |
| AA93 | ANY | AA94 | ANY |
| AA95 | ANY | AA96 | A |
| AA97 | V | AA98 | G |
| AA99 | I | AA100 | V |
| AA101 | E | AA102 | T |
| AA103 | ANY | AA104 | S |
| AA105 | V | AA106 | A |
| AA107 | A | AA108 | C |
| AA109 | I | AA110 | S |
| AA111 | A | AA112 | A |
| AA113 | D | AA114 | ANY |
| AA115 | A | AA116 | V |
| AA117 | ANY | AA118 | G |
| AA119 | S | AA120 | ANY |
| AA121 | V | AA122 | T |
| AA123 | L | AA124 | V |
| AA125 | R | AA126 | V |
| AA127 | ANY | AA128 | M |
| AA129 | A | AA130 | ANY |
| AA131 | G | AA132 | I |
| AA133 | ANY | AA134 | G |
| AA135 | K | AA136 | C |
| AA137 | Y | AA138 | M |
| AA139 | V | AA140 | V |
| AA141 | A | AA142 | G |
| AA143 | ANY | AA144 | V |
| AA145 | S | AA146 | D |
| AA147 | V | AA148 | A |
| AA149 | L | AA150 | A |
| AA151 | V | AA152 | T |
| AA153 | V | AA154 | A |
| AA155 | S | AA156 | S |
| AA157 | S | AA158 | A |
| AA159 | G | AA160 | A |
| AA161 | Y | AA162 | ANY |
| AA163 | L | AA164 | L |
| AA165 | V | AA166 | Y |
| AA167 | A | AA168 | S |
| AA169 | L | AA170 | I |
| AA171 | ANY | AA172 | ANY |
| AA173 | P | AA174 | ANY |
| AA175 | ANY | AA176 | A |
| AA177 | M | AA178 | ANY |
| AA179 | ANY | AA180 | Q |
| AA181 | M | AA182 | V |
| AA183 | ANY | AA184 | ANY |

As used throughout this application, a "defined residue" means an amino acid position in the sequence listing that recites a specific amino acid residue. All undefined residues in SEQ ID NO:1 (i.e., residues that do not include a defined residue) are present on the polypeptide surface, and thus can be substituted with a different amino acid as desired for a given purpose without disruption of the polypeptide structure that permits polypeptide self-assembly. All defined residues are present in the polypeptide interior, and thus can be modified only by conservative substitutions to maintain overall polypeptide structure to permit polypeptide self-assembly. As used here, "conservative amino acid substitution" means that:

- hydrophobic amino acids (Ala, Cys, Gly, Pro, Met, Sce, Sme, Val, Ile, Leu) can only be substituted with other hydrophobic amino acids;
- hydrophobic amino acids with bulky side chains (Phe, Tyr, Trp) can only be substituted with other hydrophobic amino acids with bulky side chains;
- amino acids with positively charged side chains (Arg, His, Lys) can only be substituted with other amino acids with positively charged side chains;
- amino acids with negatively charged side chains (Asp, Glu) can only be substituted with other amino acids with negatively charged side chains; and
- amino acids with polar uncharged side chains (Ser, Thr, Asn, Gln) can only be substituted with other amino acids with polar uncharged side chains.

For ease of review, Table 1 provides a representation of SEQ ID NO:1, where the term "AA-" refers to the amino acid residue within SEQ ID NO:1, and the term "any" means an undefined residue. As used herein, the amino acid residues are abbreviated as follows: alanine (Ala; A), asparagine (Asn; N), aspartic acid (Asp; D), arginine (Arg; R), cysteine (Cys; C), glutamic acid (Glu; E), glutamine (Gln; Q), glycine (Gly; G), histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V). A residue in parentheses within the disclosed sequences means that the residue may be absent.

In one embodiment, an O interface polypeptide includes at least 2, 3, 4, 5, 6, 7, 8, 9, 10, or more amino acid substitutions relative to SEQ ID NO: 2 (3n79-wt).

(SEQ ID NO: 2)
(M)SQAIGILELTSIAKGMELGDAMLKSANVDLLVSKTICPGKFLLMLGG

DIGAIQQAIETGTSQAGEMLVDSLVLANIHPSVLPAISGLNSVDKRQAVG

IVETWSVAACISAADRAVKGSNVTLVRVHMAFGIGGKCYMVVAGDVSDVN

NAVTVASESAGEKGLLVYRSVIPRPHEAMWRQMVEG

In one such embodiment, at least two of the following amino acid positions are changed relative to SEQ ID NO:2: AA14, AA67, AA148, AA149, AA156, AA160, AA161, AA167, and AA 169. In various embodiments, 2, 3, 4, 5, 6, 7, 8, or all 9 residues (AA14, AA67, AA148, AA149, AA156, AA160, AA161, AA167, and AA 169) in the polypeptides of this aspect of the invention are changed relative to SEQ ID NO:2.

In a further embodiment, the O interface-containing polypeptide includes no more than 100 defined residues as per SEQ ID NO:1 are modified by a conservative amino acid substitution. In various further embodiments, no more than 90, 85, 80, 75, 70, 65, 60, 55, 50, 45, 40, 35, 30, 25, 30, 15, 10, 9, 8, 7, 6, 5, 4, 3, 2, or 1 defined residues as per SEQ ID NO:1 are modified by a conservative amino acid substitution. In a further embodiment, the 0 interface-containing polypeptide comprises or consists of SEQ ID NO:1 with no defined residues modified by a conservative amino acid substitution.

In a further embodiment, the O interface-containing polypeptide comprises or consists of an amino acid sequence with at least 75% identity to the amino acid sequence of SEQ ID NO:3 (also referred to herein as "O3-33").

(SEQ ID NO: 3)
(M)SQAIGILELTSIAAGMELGDAMLKSANVDLLVSKTISPGKFLLMLGG

DIGAIQQAIETGTSQAGELLVDSLVLANIHPSVLPAISGLNSVDKRQAVG

IVETWSVAACISAADRAVKGSNVTLVRVHMAFGIGGKCYMVVAGDVSDVA

LAVTVASSSAGAYGLLVYASLIPRPHEAMWRQMVEG

In various embodiments, the O interface-containing polypeptide comprises or consists of an amino acid sequence with at least 80%, 85%, 90%, 95%, 96%, 97%, 98%, or 99% identity to the amino acid sequence of SEQ ID NO:3. In each of these embodiments, it is understood that residues in SEQ ID NO:3 corresponding to defined residues in SEQ ID NO:1 may only be substituted by conservative amino acid substitutions. In another embodiment, a polypeptide of the second aspect of the invention comprises or consists of the amino acid sequence of SEQ ID NO:3 (03-33), which is discussed by way of example herein. In a further embodiment, the O interface-containing polypeptide comprises or consists of the amino acid sequence of SEQ ID NO:4, wherein any defined residue in SEQ ID NO:4 can be modified by a conservative amino acid substitution, and wherein the polypeptide does not comprise or consist of the amino acid sequence of SEQ ID NO: 5 (3ftt-wt). For ease of review, Table 2 provides a representation of SEQ ID NO:4, where the term "AA-" refers to the amino acid residue within SEQ ID NO:4, and the term "any" means an undefined residue.

TABLE 2

(SEQ ID NO: 4)

| AA1 | M or absent | AA2 | ANY |
|---|---|---|---|
| AA3 | ANY | AA4 | ANY |
| AA5 | ANY | AA6 | ANY |
| AA7 | ANY | AA8 | ANY |
| AA9 | ANY | AA10 | ANY |
| AA11 | K | AA12 | W |
| AA13 | ANY | AA14 | D |
| AA15 | A | AA16 | ANY |
| AA17 | F | AA18 | D |
| AA19 | ANY | AA20 | T |
| AA21 | ANY | AA22 | I |
| AA23 | N | AA24 | E |
| AA25 | R | AA26 | L |
| AA27 | R | AA28 | A |
| AA29 | K | AA30 | V |
| AA31 | I | AA32 | C |
| AA33 | F | AA34 | A |
| AA35 | L | AA36 | N |
| AA37 | H | AA38 | T |
| AA39 | N | AA40 | P |
| AA41 | S, V | AA42 | ANY |
| AA43 | T | AA44 | L, M |
| AA45 | K, M | AA46 | ANY |
| AA47 | K | AA48 | V |
| AA49 | L | AA50 | I |
| AA51 | D | AA52 | A |
| AA53 | L | AA54 | F |
| AA55 | Q | AA56 | T |
| AA57 | T | AA58 | ANY |
| AA59 | ANY | AA60 | N |
| AA61 | ANY | AA62 | S |
| AA63 | I | AA64 | S |
| AA65 | I | AA66 | P |
| AA67 | F | AA68 | D |
| AA69 | T | AA70 | D |
| AA71 | Y | AA72 | G |
| AA73 | W | AA74 | N |
| AA75 | ANY | AA76 | K |
| AA77 | L | AA78 | ANY |
| AA79 | ANY | AA80 | N |
| AA81 | V | AA82 | Y |
| AA83 | V | AA84 | N |
| AA85 | T | AA86 | N |
| AA87 | C | AA88 | Y |
| AA89 | F | AA90 | M |
| AA91 | D | AA92 | ANY |
| AA93 | G | AA94 | ANY |
| AA95 | I | AA96 | T |
| AA97 | ANY | AA98 | G |
| AA99 | D | AA100 | N |
| AA101 | V | AA102 | F |
| AA103 | I | AA104 | G |
| AA105 | P | AA106 | N |
| AA107 | C | AA108 | G |
| AA109 | F | AA110 | Y |
| AA111 | ANY | AA112 | A |
| AA113 | T | AA114 | ANY |
| AA115 | P | AA116 | ANY |
| AA117 | ANY | AA118 | ANY |
| AA119 | H | AA120 | H |
| AA121 | ANY | AA122 | N |
| AA123 | ANY | AA124 | G |
| AA125 | ANY | AA126 | E |
| AA127 | K | AA128 | A |
| AA129 | G | AA130 | ANY |
| AA131 | I | AA132 | H |
| AA133 | I | AA134 | G |
| AA135 | S | AA136 | N |
| AA137 | T | AA138 | W |
| AA139 | F | AA140 | G |
| AA141 | G | AA142 | H |
| AA143 | V | AA144 | A |
| AA145 | V | AA146 | L |
| AA147 | P | AA148 | ANY |
| AA149 | V | AA150 | T |
| AA151 | ANY | AA152 | G |
| AA153 | E | AA154 | G |
| AA155 | S | AA156 | V |

TABLE 2-continued (SEQ ID NO: 4)

| | | | |
|---|---|---|---|
| AA157 | I | AA158 | G |
| AA159 | A | AA160 | G |
| AA161 | S | AA162 | V |
| AA163 | ANY | AA164 | ANY |
| AA165 | K | AA166 | ANY |
| AA167 | ANY | AA168 | ANY |
| AA169 | P | AA170 | H |
| AA171 | S | AA172 | ANY |
| AA173 | A | AA174 | V |
| AA175 | ANY | AA176 | N |
| AA177 | ANY | AA178 | ANY |
| AA179 | ANY | AA180 | ANY |
| AA181 | ANY | AA182 | R |
| AA183 | ANY | AA184 | I |
| AA185 | ANY | AA186 | ANY |
| AA187 | D | AA188 | L |
| AA189 | P | AA190 | S |
| AA191 | E | AA192 | T |
| AA193 | L | AA194 | N |
| AA195 | D | AA196 | E |
| AA197 | T | AA198 | I |
| AA199 | K | | |

In one embodiment, the O interface-containing polypeptide includes at least 2, 3, 4, 5, 6, 7, 8, 9, 10, or more amino acid substitutions relative to SEQ ID NO: 5 (3ftt-wt) or SEQ ID NO: 6 (3n79-wt).

```
                                          (SEQ ID NO: 5)
(M)TEKEKMLAEKWYDANFDQYLINERARAKDICFELNHTRPSATNKRK

ELIDQLFQTTTDNVSISIPFDTDYGWNVKLGKNVYVNTNCYFMDGGQIT

IGDNVFIGPNCGFYTATHPLNFHHRNEGFEKAGPIHIGSNTWFGGHVAV

LPGVTIGEGSVIGAGSVVTKDIPPHSLAVGNPCKVVRKIDNDLPSETLN

DETIK
```

In one such embodiment, at least two of the following amino acid positions are changed relative to SEQ ID NO:5: AA20, AA26, AA30, AA34, AA39, AA41, AA44, AA48, and AA 52. In various embodiments, 2, 3, 4, 5, 6, 7, 8, or all 9 residues (AA20, AA26, AA30, AA34, AA39, AA41, AA44, AA48, and AA 52) in the polypeptides of the second aspect of the invention are changed relative to SEQ ID NO:5.

In a further embodiment, the O interface-containing polypeptide includes no more than 100 defined residues as per SEQ ID NO:4 are modified by a conservative amino acid substitution. In various further embodiments, no more than 90, 85, 80, 75, 70, 65, 60, 55, 50, 45, 40, 35, 30, 25, 30, 15, 10, 9, 8, 7, 6, 5, 4, 3, 2, or 1 defined residues as per SEQ ID NO:4 are modified by a conservative amino acid substitution. In a further embodiment, the 0 interface-containing polypeptide comprises or consists of SEQ ID NO:4 with no defined residues modified by a conservative amino acid substitution.

In a further embodiment, the O interface-containing polypeptide comprises or consists of an amino acid sequence with at least 75% identity to an amino acid sequence selected from the group consisting of SEQ ID NO:9, SEQ ID NO: 7 (also referred to herein as "T3-08"), and SEQ ID NO:8 (also referred to herein as "T3-10").

```
T3-08
                                          (SEQ ID NO: 7)
(M)TEKEKMLAEKWYDANFDQTLINERLRAKVICFALNHTNPSATLKRK

VLIDALFQTTTDNVSISIPFDTDYGWNVKLGKNVYVNTNCYFMDGGQIT

IGDNVFIGPNCGFYTATHPLNFHHRNEGFEKAGPIHIGSNTWFGGHVAV

LPGVTIGEGSVIGAGSVVTKDIPPHSLAVGNPCKVVRKIDNDLPSETLN

DETIK

T3-10
                                          (SEQ ID NO: 8)
(M)TEKEKMLAEKWYDANFDQTLINERLRAKVICFALNHTNPVATMMRK

VLIDALFQTTTDNVSISIPFDTDYGWNVKLGKNVYVNTNCYFMDGGQIT

IGDNVFIGPNCGFYTATHPLNFHHRNEGFEKAGPIHIGSNTWFGGHVAV

LPGVTIGEGSVIGAGSVVTKDIPPHSLAVGNPCKVVRKIDNDLPSETLN

DETIK;
or

SEQ ID NO: 9.
```

In various embodiments, the O interface-containing polypeptide comprises or consists of an amino acid sequence with at least 80%, 85%, 90%, 95%, 96%, 97%, 98%, or 99% identity to an amino acid sequence selected from the group consisting of SEQ ID NO:7, SEQ ID NO: 8, and SEQ ID NO: 9. In each of these embodiments, it is understood that residues in SEQ ID NO:7, 8, or 9 corresponding to defined residues in SEQ ID NO:4 may only be substituted by conservative amino acid substitutions. In another embodiment, the 0 interface-containing polypeptide comprises or consists of an amino acid sequence selected from the group consisting of SEQ ID NO:7, SEQ ID NO:8, and SEQ ID NO:9, which are discussed by way of example herein.

In another embodiment, the O interface-containing polypeptide comprises or consists of a polypeptide selected from SEQ ID NOS: 10-19, which are particularly useful in generating the assemblies of the second aspect of the invention.

In another embodiment, the O interface-containing polypeptide comprises or consists of a polypeptide selected from SEQ ID NOS: 22-51.

In another embodiment, the O interface-containing polypeptide comprises or consists of a polypeptide with at least 75%, 80%, 85%, 90%, 95%, 96%, 97%, 98%, 99%, or 100% identity to the amino acid sequence of SEQ ID NO: 20 (I3-01) or 304 (I3-01(M3I);

wherein the polypeptide includes at least 1, 2, 3, 4, 5, or more amino acid substitutions compared to SEQ NO: 21 (1wa3-wt).

```
(I3-01)                                      SEQ ID: 20
(M)KMEELFKKHKIVAVLRANSVEEAKKKALAVFLGGVHLIEITFTVPDAD

TVIKELSFLKEMGAIIGAGTVTSVEQCRKAVESGAEFIVSPHLDEEISQFC

KEKGVFYMPGVMTPTELVKAMKLGHTILKLFPGEVVGPQFVKAMKGPFPNV

KFVPTGGVNLDNVCEWFKAGVLAVGVGSALVKGTPVEVAEKAKAFVEKIRG

CTE;
or (I3-01(M3I)                                 SEQ ID: 304
(M)KIEELFKKHKIVAVLRANSVEEAKKKALAVFLGGVHLIEITFTVPDAD

TVIKELSFLKEMGAIIGAGTVTSVEQCRKAVESGAEFIVSPHLDEEISQFC
```

```
-continued
KEKGVFYMPGVMTPTELVKAMKLGHTILKLFPGEVVGPQFVKAMKGPFPNV

KFVPTGGVNLDNVCEWFKAGVLAVGVGSALVKGTPVEVAEKAKAFVEKIRG

CTE (1wa3-wt)                                       SEQ ID: 21
MKMEELFKKHKIVAVLRANSVEEAKEKALAVFEGGVHLIEITFTVPDADTV

IKELSFLKEKGAIIGAGTVTSVEQCRKAVESGAEFIVSPHLDEEISQFCKE

KGVFYMPGVMTPTELVKAMKLGHTILKLFPGEVVGPQFVKAMKGPFPNVKF

VPTGGVNLDNVCEWFKAGVLAVGVGSALVKGTPDEVREKAKAFVEKIRGCT

E.
```

In another embodiment, the O-interface containing first protein and the second proteins comprise or consist of proteins selected from the following pairs of first and second proteins:

(a) T32-28A (SEQ ID NO: 22) and T32-28B (SEQ ID NO: 23);
(b) T33-09A (SEQ ID NO: 24) and T33-09B (SEQ ID NO: 25);
(c) T33-15A (SEQ ID NO: 26) and T33-15B (SEQ ID NO: 27);
(d) T33-21A (SEQ ID NO: 28) and T33-21B (SEQ ID NO: 29); and
(e) T33-28A (SEQ ID NO: 30) and T33-28B (SEQ ID NO: 31).

In a further embodiment the O-interface containing first protein and the second proteins comprise or consist of proteins selected from the following pairs of first and second proteins:

(a) T32-28A (SEQ ID NO: 32) and T32-28B (SEQ ID NO: 33);
(b) T33-09A (SEQ ID NO: 34) and T33-09B (SEQ ID NO: 35);
(c) T33-15A (SEQ ID NO: 36) and T33-15B (SEQ ID NO: 37);
(d) T33-21A (SEQ ID NO: 38) and T33-21B (SEQ ID NO: 39); and
(e) T33-28A (SEQ ID NO: 40) and T33-28B (SEQ ID NO: 41).

In another embodiment, the O-interface containing first protein and the second proteins comprise or consist of proteins selected from the following pairs of first and second proteins:

(a) T32-28A (SEQ ID NO: 42) and T32-28B (SEQ ID NO: 43);
(b) T33-09A (SEQ ID NO: 44) and T33-09B (SEQ ID NO: 45);
(c) T33-15A (SEQ ID NO: 46) and T33-15B (SEQ ID NO: 47);
(d) T33-21A (SEQ ID NO: 48) and T33-21B (SEQ ID NO: 49); and
(e) T33-28A (SEQ ID NO: 50) and T33-28B (SEQ ID NO: 51).

In one embodiment, the O-interface containing first protein and the second proteins comprise or consist of proteins selected from the following pairs of first and second proteins:

(a) T32-28A (SEQ ID NO: 22, 32, or 42) and T32-28B SEQ ID NO: 23, 33, or 43), wherein the first protein is at least 70% identical to the amino acid sequence of SEQ ID NO: 1 and the second protein is at least 70% identical to the amino acid sequence of SEQ ID NO: 11;

(b) T33-09A SEQ ID NO: 24, 34, or 44) and T33-09B SEQ ID NO: 25, 35, or 45), wherein the first protein is at least 70% identical to the amino acid sequence of SEQ ID NO: 12 and the second protein is at least 70% identical to the amino acid sequence of SEQ ID NO: 13;

(c) T33-15A SEQ ID NO: 26, 36, or 46) and T33-15B SEQ ID NO: 27, 37, or 47), wherein the first protein is at least 70% identical to the amino acid sequence of SEQ ID NO: 14 and the second protein is at least 70% identical to the amino acid sequence of SEQ ID NO: 15;

(d) T33-21A SEQ ID NO: 28, 38 or 48) and T33-21B SEQ ID NO: 29, 39 or 49), wherein the first protein is at least 70% identical to the amino acid sequence of SEQ ID NO: 16 and the second protein is at least 70% identical to the amino acid sequence of SEQ ID NO: 17; and (e) T33-28A SEQ ID NO: 30, 40, or 50) and T33-28B SEQ ID NO: 31, 41, or 51), wherein the first protein is at least 70% identical to the amino acid sequence of SEQ ID NO: 18 and the second protein is at least 70% identical to the amino acid sequence of SEQ ID NO: 19.

In various further embodiments, the first and second proteins are at least 75%, 80%, 85%, 90%, 91%, 92%, 93%, 94%, 95%, 96%, 97%, or 98% identical to the amino acid sequence of the designed protein.

In various further embodiments, the O-interface containing first protein and the second proteins comprise or consist of proteins selected from the following pairs of first and second proteins (a) T32-28A (SEQ ID NO:10) and T32-28B (SEQ ID NO:11);
(b) T33-09A (SEQ ID NO:12) and T33-09B (SEQ ID NO:13);
(c) T33-15A (SEQ ID NO:14) and T33-15B (SEQ ID NO:15);
(d) T33-21A (SEQ ID NO:16) and T33-21B (SEQ ID NO:17); and
(e) T33-28A (SEQ ID NO:18) and T33-28B (SEQ ID NO:19).

In various further embodiments, the O-interface containing first protein and the second proteins comprise or consist of proteins selected from the following pairs of first and second proteins:

(A) I53-34A (SEQ ID NO: 270) and I53-34B (SEQ ID NO: 271);
(B) I53-40A (SEQ ID NO: 272) and I53-40B (SEQ ID NO: 273);
(C) I53-47A (SEQ ID NO: 274) and I53-47B (SEQ ID NO: 275);
(D) I53-50A (SEQ ID NO: 276) and I53-50B (SEQ ID NO: 277); and
(E) I53-51A (SEQ ID NO: 278) and I53-51B (SEQ ID NO: 279).

An "M domain" for use in the present invention can be any suitable polypeptide that is capable of binding to a lipid bilayer via any suitable mechanism, including but not limited to non-covalently interacting with the lipid bilayer membrane. In various embodiments, such interactions may include but are not limited to interacting via specific binding pockets with the polar head groups of lipid molecules in the lipid bilayer, interacting electrostatically with charged polar head groups, interacting non-covalently with the hydrophobic interior of the lipid bilayer, or by harboring a chemical modification (non-limiting examples may be fatty acid or acylation modifications such as myristoylation) that interacts non-covalently with the lipid bilayer. A given M domain may employ one or more mechanisms of interaction with a lipid bilayer. Each multimeric assembly comprises one or more M domains. In some embodiments, each oligomeric substructure in a multimeric assembly comprises one or more M domains. In other embodiments, some fraction (30%, 40%, 50%, 60%, 70%, 80%, 90%, or more) of the plurality of proteins comprise one or more M domains. In other embodiments, each protein in the plurality of proteins comprises one or more M domains. In all embodiments, one or more M domains is required per multimeric assembly in order to drive association of the multimeric assembly with the lipid bilayer via any suitable mechanism.

The M domains present in a resulting multimeric assembly may all be the same, all different, or some the same and some different.

In various embodiments, the one or more M domains may comprise or consist of a polypeptide having an acylation motif, including but not limited to N-terminal myristoylation motifs (including but not limited to MGXXXT/S (SEQ ID NO: 300) motif and non-limiting example sequences 1-92 below), palmitoylation motifs (including but not limited to non-limiting example sequences 93-99 below), farnesylation motifs, and geranylgeranylation motifs (Resh M (1999) Fatty acylation of proteins: new insights into membrane targeting of myristoylated and palmitoylated proteins. Biochim. Biophys. Acta 1451:1-16; Resh M (2013) Covalent lipid modifications of proteins. Curr. Biol. 23:R431-5); a polar headgroup-binding domain (including but not limited to non-limiting example sequences 100-106 in the attached appendices and the domains defined in: Stahelin R V (2009) Lipid binding domains: more than simple lipid effectors. J. Lipid Res. 50:S299-304); or transmembrane protein domains (the latter preferably when the multimeric assembly is enveloped by a lipid bilayer). In various further embodiments, the M domain may comprise envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55 and CD59.

In further embodiments, the M domain may comprise or consist of one or more of the following peptides:

```
                                               (SEQ ID NO: 280)
(M)GARAS (Myr1; 6 N-terminal residues of HIV gag);

(SEQ ID NO: 281)
(M)GAQFS (Myr2; 6 N-terminal residues of MARCKS);

(SEQ ID NO: 282)
(M)GSSKS (Myr3; 6 N-terminal residues of Src);

(SEQ ID NO: 283)
(M)GKQNS (Myr4; 6 N-terminal residues of

Neurocalcin);

(SEQ ID NO: 284)
(M)GCIKSKRKDNLN (Palm 1; 13 N-terminal residues of

Lyn kinase);

(SEQ ID NO: 285)
(M)GCTLSAEERAAL (Palm2; 13 N-terminal residues of

Gao);

(SEQ ID NO: 286)
(M)LCCMRRTKQVEK (Palm3; 13 N-terminal residues of

GAP43);
```

```
-continued
                                               (SEQ ID NO: 287)
(M)DCLCIVTTKKYR (Palm4; 13 N-terminal residues of

PSD-95);

(SEQ ID NO: 288)
KKKKKSKTKC VIM (CaaX1; 13 C-terminal residues from

K-Ras4B);

(SEQ ID NO: 289)
DMKKHRCKCCSIM (CaaX2; 13 C-terminal residues from paralemmin);

(SEQ ID NO: 290)
AQRQKKRRLCLLL (CaaX3; 13 C-terminal residues of

RhoF);

(SEQ ID NO: 291)
AQEFIHQFLCNPL (CaaX4; 13 C-terminal residues of type II inositol 1,4,5-trisphosphate 5-phosphatase isoform X7);

(SEQ ID NO: 292)
HGLQDDPDLQALLKGSQLLKVKSSSWRRERFYKLQEDCKTIWQESRKVMRS

PESQLFSIEDIQEVRMGHRTEGLEKFARDIPEDRCFSIVFKDQRNTLDLIA

PSPADAQHWVQGLRKIIHHSGSMDQRQK (PH; Residues 11-40 of rat PLC);

(SEQ ID NO: 293)
PHRFKVHNYMSPTFCDHCGSLLWGLVKQGLKCEDCGMNVHHKCREKVANLC

G (C1; residues 246-297 of human PCK6 isoform X2);

(SEQ ID NO: 294)
GAVKLSVSYRNGTLFIIVIVMHIKDLVTEDGADPNPYVKTYLLPDTHKTSK

RKTKISRKTRNPTFNEMLVYSGYSKETLRQRELQLSVLSAESLRENFFLGG

ITLPLKDFNLSKETVKWYQLTAATYL (C2; residues 1384-1509 of mouse PI3K);
and/or (SEQ ID NO: 295)
AVAQQLRAESDFEQLPDDVAISANIADIEEKRGFTSHFVFVIEVKTKGGSK

YLIYRRYRQFHALQSKLEERFGPDSKSSALACTLPTLPAKVYVGVKQEIAE

MRIPALNAYMKSLLSLPVWVLMDEDVRIFFYQSPYDSEQVPQALRR (PX; residues 2-149 of human p40phox)
```

Further exemplary M domains may comprise or consist of one or more of the peptides that follow (Resh M (1999) Biochim. Biophys. Acta 1451:1-16; Resh M (2013) Curr. Biol. 23:R431-5; Stahelin R V (2009) J. Lipid Res. 50:S299-304).

A. The following peptides must be at the N terminus of the polypeptide in which they appear in order to function as an M domain.

1. Any amino acid sequence conforming to the consensus motif (M)GXXX(S/T) (SEQ ID NO: 300), where the M is in the initiator methionine at the N terminus of the polypeptide sequence.

-continued 2. (M)GARAS (SEQ ID NO: 280)
3. (M)GCIKSKGKDSLS (SEQ ID NO: 296)
4. (M)GCINSKRKD (SEQ ID NO: 297)
5. (M)GSSKSKPKDPSQRRR (SEQ ID NO: 298)
6. (M)GCIKSKEDKGPAMKY (SEQ ID NO: 299)
7. (M)GCVQCKDKEATKLTE (SEQ ID NO: 52)
8. (M)GCIKSKRKDNLNDDE (SEQ ID NO: 53)
9. (M)GCVCSSNPEDDWMEN (SEQ ID NO: 54)
10. (M)GCMKSKFLQVGGNTG (SEQ ID NO: 55)
11. (M)GCVFCKKLEPVATAK (SEQ ID NO: 56)
12. (M)GCVHCKEKISGKGQG (SEQ ID NO: 57)
13. (M)GLLSSKRQVSEKGKG (SEQ ID NO: 58)
14. (M)GQQPGKVLGDQRRPS (SEQ ID NO: 59)
15. (M)GQQVGRVGEAPGLQQ (SEQ ID NO: 60)
16. (M)GNAAAAKKGSEQESV (SEQ ID NO: 61)
17. (M)GNAATAKKGSEVESV (SEQ ID NO: 62)
18. (M)GAQLSLVVQASPSIA (SEQ ID NO: 63)
19. (M)GHALCVCSRGTVIID (SEQ ID NO: 64)
20. (M)GQLCCFPFSRDEGKI (SEQ ID NO: 65)
21. (M)GNEASYPLEMCSHFD (SEQ ID NO: 66)
22. (M)GNSGSKQHTKHNSKK (SEQ ID NO: 67)
23. (M)GCTLSAEDKAAVERS (SEQ ID NO: 68)
24. (M)GCTLSAEERAALERS (SEQ ID NO: 69)
25. (M)GAGASAEEKHSRELE (SEQ ID NO: 70)
26. (M)GCRQSSEEKEAARRS (SEQ ID NO: 71)
27. (M)GLSFTKLFSRLFAKK (SEQ ID NO: 72)
28. (M)GNIFGNLLKSLIGKK (SEQ ID NO: 73)
29. (M)GLTVSALFSRIFGKK (SEQ ID NO: 74)
30. (M)GKVLSKIFGNKEMRI (SEQ ID NO: 75)
31. (M)GNSKSGALSKEILEE (SEQ ID NO: 76)
32. (M)GKQNSKLRPEVMQDL (SEQ ID NO: 77)
33. (M)GKRASKLKPEEVEEL (SEQ ID NO: 78)
34. (M)GKQNSKLRPEVLQDL (SEQ ID NO: 79)
35. (M)GSRASTLLRDEELEE (SEQ ID NO: 80)
36. (M)GSKLSKKKKGYNVND (SEQ ID NO: 81)
37. (M)GKQNSKLRPEMLQDL (SEQ ID NO: 82)
38. (M)GNVMEGKSVEELSST (SEQ ID NO: 83)
39. (M)GQQFSWEEAEENGAV (SEQ ID NO: 84)
40. (M)GNTKSGALSKEILEE (SEQ ID NO: 85)
41. (M)GKQNSKLRPEVLQDL (SEQ ID NO: 86)
42. (M)GAQFSKTAAKGEATA (SEQ ID NO: 87)
43. (M)GSQSSKAPRGDVTAE (SEQ ID NO: 88)
44. (M)GNRHAKASSPQGFDV (SEQ ID NO: 89)
45. (M)GQDQTKQQIEKGLQL (SEQ ID NO: 90)
46. (M)GQALSIKSCDFHAAE (SEQ ID NO: 91)
47. (M)GNRAFKAHNGHYLSA (SEQ ID NO: 92)
48. (M)GARASVLSGGELDRW (SEQ ID NO: 93)
49. (M)GQTVTTPLSLTLDHW (SEQ ID NO: 94)
50. (M)GQAVTTPLSLTLDHW (SEQ ID NO: 95)
51. (M)GNSPSYNPPAGISPS (SEQ ID NO: 96)
52. (M)GQTLTTPLSLTLTHF (SEQ ID NO: 97)
53. (M)GQTITTPLSLTLDHW (SEQ ID NO: 98)
54. (M)GQTVTTPLSLTLEHW (SEQ ID NO: 99)
55. (M)GQELSQHERYVEQLK (SEQ ID NO: 100)
56. (M)GVSGSKGQKLFVSVL (SEQ ID NO: 101)
57. (M)GGKWSKSSVVGWPTV (SEQ ID NO: 102)
58. (M)GQHPAKSMDVRRIEG (SEQ ID NO: 103)
59. (M)GAQVSRQNVGTHSTQ (SEQ ID NO: 104)
60. (M)GLAFSGARPCCCRHN (SEQ ID NO: 105)
61. (M)GNRGSSTSSRPPLSS (SEQ ID NO: 106)
62. (M)GSYFVPPANYFFKDI (SEQ ID NO: 107)
63. (M)GAQLSTLSRVVLSPV (SEQ ID NO: 108)
64. (M)GNLKSVGQEPGPPCG (SEQ ID NO: 109)
65. (M)GSKRSVPSRHRSLTT (SEQ ID NO: 110)
66. (M)GNGESQLSSVPAQKL (SEQ ID NO: 111)
67. (M)GAHLVRRYLGDASVE (SEQ ID NO: 112)
68. (M)GGKLSKKKKGYNVND (SEQ ID NO: 113)
69. (M)GSCCSCPDKDTVPDN (SEQ ID NO: 114)
70. (M)GSSEVSIIPGLQKEE (SEQ ID NO: 115)
71. (M)LCCMRRTKQVEKNDE (SEQ ID NO: 116)
72. (M)GCLGNSKTEDQRNE (SEQ ID NO: 117)
73. (M)TLESIMACCLSEEAKEA (SEQ ID NO: 118)
74. (M)SGVVRTLSRCLLPAEAG (SEQ ID NO: 119)
75. (M)ADFLPSRSVCFPGCVLTN (SEQ ID NO: 120)
76. (M)ARSLRWRCCPWCLTEDEKAA (SEQ ID NO: 121)
77. (M)LCCMRRTKQVEKNDDDQKIEQDGI (SEQ ID NO: 122)
78. (M)QCCGLVHRRRVRV (SEQ ID NO: 123)
79. (M)DCLCIVTTKKYRYQDEDTP (SEQ ID NO: 124)
80. (M)CKGLAGLPASCLRSAKDMK (SEQ ID NO: 125)
81. (M)GCIKSKEDKGPAMKY (SEQ ID NO: 126)
82. (M)GCVQCKDKEATKLTE (SEQ ID NO: 127)

83. (M)GCIKSKRKDNLNDDE (SEQ ID NO: 128)

84. (M)GCVCSSNPEDDWMEN (SEQ ID NO: 129)

85. (M)GCMKSKFLQVGGNTG (SEQ ID NO: 130)

86. (M)GCVFCKKLEPVATAK (SEQ ID NO: 131)

87. (M)GCVHCKEKISGKGQG (SEQ ID NO: 132)

88. (M)GCTLSAEDKAAVERS (SEQ ID NO: 133)

89. (M)GCTLSAEERAALERS (SEQ ID NO: 134)

90. (M)GCRQSSEEKEAARRS (SEQ ID NO: 135)

91. (M)GQLCCFPFSRDEGK (SEQ ID NO: 136)

92. (M)GNLKSVGQEPGPPCGLGLGLGLGLCGK (SEQ ID NO: 137)

B. The following peptides must be at the C terminus of the polypeptide in which they appear in order to function as an M domain.

93. SGPGCMSCKCVLS (SEQ ID NO: 138)

94. GTQGCMGLPCVVM (SEQ ID NO: 139)

95. TPGCVKIKKCVIM (SEQ ID NO: 140)

96. DMKKHRCKCCSIM (SEQ ID NO: 141)

97. SKDGKKKKKSKTKC VIM (SEQ ID NO: 142)

98. KKKKKKSKTKC VIM (SEQ ID NO: 143)

99. SKTKC VIM (SEQ ID NO: 144)

C. The following peptides are non-limiting examples of polar headgroup-binding domains that can function as M domains. These domains can appear anywhere in the polypeptides of the invention consistent with proper folding and multimerization of the multimeric assembly.

100. HGLQDDDPDLQALLKGSQLLKVKSSSWRRERFYKLQEDCKTIWQESR
KVMRSPESQLFSIEDIQEVRMGHRTEGLEKFARDIPEDRCFSIVFKDQRNT
LDLIAPSPADAQHWVQGLRKIIHHSGSMDQRQK (SEQ ID NO: 145)

101. (M)DSGRDFLTLHGLQDDPDLQALLKGSQLLKVKSSSWRRERFYKL
QEDCKTIWQESRKVMRSPESQLFSIEDIQEVRMGHRTEGLEKFARDIPEDR
CFSIVFKDQRNTLDLIAPSPADAQHWVQGLRKIIHHSGSMDQRQK
(SEQ ID NO: 146)

102. (M)DSGRDFLTLHGLQDDPDLQALLKGSQLLKVKSSSWRRERFYKL
QEDCKTIWQESRKVMRSPESQLFSIEDIQEVRMGHRTEGLEKFARDIPEDR
CFSIVFKDQRNTLDLIAPSPADVQHWVQGLRKIIDRSGSMDQRQK
(SEQ ID NO: 147)

103. (M)DSGRDFLTLHGLQDDEDLQALLKGSQLLKVKSSSWRRERFYKL
QEDCKTIWQESRKVMRTPESQLFSIEDIQEVRMGHRTEGLEKFARDVPEDR
CFSIVFKDQRNTLDLIAPSPADAQHWVLGLHKIIHHSGSMDQRQK
(SEQ ID NO: 148)

104. HGLQDDEDLQALLKGSQLLKVKSSSWRRERFYKLQEDCKTIWQESR
KVMRTPESQLFSIEDIQEVRMGHRTEGLEKFARDVPEDRCFSIVFKDQRNT
LDLIAPSPADAQHWVLGLHKIIHHSGSMDQRQK (SEQ ID NO: 149)

105. (M)SGGKYVDSEGHLYTVPIREQGNIYKPNNKAMAEEMNEKQVYDA
HTKEIDLVNRDPKHLNDDVVKIDFEDVIAEPEGTHSFDGIWKASFTTFTVT
KYWFYRLLSALFGIPMALIWGIYFAILSFLHIWAVVPCIKSFLIEIQCISR
VYSIYVHTFCDPLFEAIGKIFSNIRINTQKEI (SEQ ID NO: 150)

106. (M)SGGKYVDSEGHLYTVPIREQGNIYKPNNKAMADELSEKQVYDA
HTKEIDLVNRDPKHLNDDVVKIDFEDVIAEPEGTHSFDGIWKASFTTFTVT
KYWFYRLLSALFGIPMALIWGIYFAILSFLHIWAVVPCIKSFLIEIQCISR
VYSIYVHTVCDPLFEAVGKIFSNVRINLQKEI (SEQ ID NO: 151)

Based on the disclosure herein, it is well within the level of those of skill in the art to identify M domains suitable for use in producing the multimeric assemblies of the invention. In one embodiment, a suitable M domain can be identified as follows:

As described elsewhere in this application, an M domain for use in the present invention can be any suitable polypeptide domain that is capable of binding to a lipid bilayer via any suitable mechanism, including but not limited to non-covalently interacting with the lipid bilayer membrane. As will be known to those of skill in the art, an M domain can be demonstrated to perform the function of membrane binding using a variety of standard assays. Many in vitro assays exist for assaying whether or not a polypeptide interacts with lipid membranes and for evaluating the characteristics of the interaction, such as the nature of the interaction (e.g., electrostatic or hydrophobic), the strength of the interaction, and whether the interaction deforms or remodels the membrane. Such assays include but are not limited to vesicle sedimentation assays, vesicle co-flotation assays, isothermal titration calorimetry, measuring changes in intrinsic or extrinsic protein or lipid fluorescence, fluorescence anisotropy, and membrane morphology analysis by electron microscopy or fluorescence microscopy (Zhao H, Lappalainen P (2012) A simple guide to biochemical approaches for analyzing lipid-protein interactions. Mol. Biol. Cell 23:2823-30). In addition, M domain-dependent localization of proteins to membranes in cells can also be used as an assay for the interaction of an M domain with membranes, and can yield information about the specificity of a given M domain for particular membranes, membrane subdomains, or lipids (Zacharias D A, Violin J D, Newton A C, Tsien R Y (2002) Partitioning of lipid-modified GFPs into membrane microdomains in live cells. Science 296:913-916; Lemmon M A (2008) Membrane recognition by phospholipid-binding domains. Nat. Rev. Mol. Cell. Biol. 9:99-111). Whether in vitro or in cells, either an isolated M domain or an M domain linked via genetic fusion or another method to a carrier protein that facilitates observation (for example, green fluorescent protein) can be used to evaluate the ability of the M domain to interact with lipid membranes.

An L domain for use in the present invention can be any suitable polypeptide that is capable of effecting membrane scission by recruiting the ESCRT machinery to the site of budding by binding to one or more ESCRT or ESCRT-associated proteins directly or indirectly via any suitable mechanism, including but not limited to non-covalently or covalently. Preferably, the L domain interacts with proteins known to recruit the ESCRT machinery to sites of budding in vivo, such as Tsg101, ALIX, or the Nedd4 family of ubiquitin E3 ligases (McDonald B, Martin-Serrano J (2009) No strings attached: the ESCRT machinery in viral budding and cytokinesis. J. Cell Sci. 122:2167-77; Votteler J, Sundquist W I (2013) Virus budding and the ESCRT pathway. Cell Host & Microbe 14:232-41). Most preferably, the L domain interacts with the human, murine, or other mammalian forms of these proteins. Each protein subunit in a multimeric assembly contains one or more L domains. The L domains present in a resulting multimeric assembly may all be the same, all different, or some the same and some different.

In various embodiments, the one or more L domains may comprise or consist of a a linear amino acid sequence motif selected from the group consisting of P(T/S)AP (SEQ ID NO: 152), $\Phi YX_{0/2}(P/\Phi)X_{0/3}(L/I)$ (SEQ ID NO: 153), PPXY (SEQ ID NO: 154), and overlapping combinations thereof (Bieniasz P D (2006) Late budding domains and host proteins in enveloped virus release. Virology 344:55-63; Votteler J, Sundquist W I (2013) Virus budding and the ESCRT pathway. Cell Host & Microbe 14:232-41), where Φ denotes a hydrophobic residue, X can be any amino acid, and numbered subscripts indicate amino acid spacers of varying lengths. Such overlapping combinations include, but are not limited to P(T/S)APPXY (SEQ ID NO: 155), $P(T/S)APYP(X)_nL$ (SEQ ID NO: 156), PPXYP(T/S)AP (SEQ ID NO: 157), $PPXYYP(X)_nL$ (SEQ ID NO: 158), $YP(X)_nLPPXY$ (SEQ ID NO: 159), and $YP(X)_nLPPXY$ (SEQ ID NO: 160).

Further exemplary L domains may comprise or consist of one or more of the peptides that follow:

(SEQ ID NO: 161)
PTAPPEE;

(SEQ ID NO: 162)
YPLTSL;

(SEQ ID NO: 163)
PTAPPEY;

(SEQ ID NO: 164)
YPDL;

(SEQ ID NO: 165)
FPIV;

(SEQ ID NO: 166)
PTAPPEY;

(SEQ ID NO: 167)
PTAP;

(SEQ ID NO: 168)
PPEY;

(SEQ ID NO: 169)
YPLTSL;
and/or (SEQ ID NO: 165)
FPIV.

As will be understood by those of skill in the art, the L domain may include additional sequences, beyond those directly responsible for recruiting the ESCRT machinery, as appropriate for an intended use, so long as the ESCRT-recruitment motifs are not buried in the peptide core in such a way as to render them inaccessible for binding their interaction partners. In various further embodiments, the L domain may comprise or consist of the following peptides that include one or more ESCRT-recruitment motifs plus additional residues (ESCRT-recruitment motifs noted by underlined text):

(SEQ ID NO: 172)
LQSRPEPTAPPEESFRSGVETTTPPQKQEPIDKELYPLTSLRSLFGNDPSSQ (HIV Gag p6 domain);

(SEQ ID NO: 173)
RRVILPTAPPEYMEAIYPVR (residues 2-21 of Ebola VP40);

(SEQ ID NO: 174)
PIQQKSQHNKSVVQETPQTQNLYPDLSEIKKEYNVKEKDQVEDLNLDSLWE (EIAV Gag p9 domain);

(SEQ ID NO: 175)
NPRQSIKAFPIVINSDGGEK (residues 12-31 of 5V5 M);

(SEQ ID NO: 176)
PTAPPEYGGS;

(SEQ ID NO: 177)
PTAPGGS;

(SEQ ID NO: 178)
PPEYGGS;

(SEQ ID NO: 179)
YPLTSLGGS;

(SEQ ID NO: 180)
YPDLGGS;

(SEQ ID NO: 181)
FPIVGGS;

(SEQ ID NO: 182)
LQSRPEAAAAPEESFRSGVETTTPPQKQEPIDKELYPLTSLRSLFGNDPSSQ (HIV Gag p6 domain mutant, (SEQ ID NO: 183)
p6(ΔPTAP));
and/or (SEQ ID NO: 184)
LQSRPEPTAPPEESFRSGVETTTPPQKQEPIDKELAALTSLRSLFGNDPSSQ (HIV Gag p6 domain mutant p6(ΔYP)), Further exemplary L domains comprise or consist of one or more of the following polypeptides:

1. QSRPEPTAPPEESFRSGVETTTPPQKQEPIDKELYPLTSLRSLFGNDPSSQ (SEQ ID NO: 186)
2. DPQIPPPPYVEPTAPQV (SEQ ID NO: 187)
3. LLTEDPPPYRD (SEQ ID NO: 188)
4. TASAPPPPYVG (SEQ ID NO: 189)
5. TPQTQNLYPDLSEIK (SEQ ID NO: 190)
6. (M)RRVILPTAPPEYMEAI (SEQ ID NO: 191)
7. NTYMQYLNPPPYADHS (SEQ ID NO: 192)
8. LGIAPPPYEEDTSMEYAPSAP (SEQ ID NO: 193)
9. DDLWLPPPEYVPLKEL (SEQ ID NO: 194)
10. AAPTAPPTGAADSIPPPYSP (SEQ ID NO: 195)

-continued

11. TAPSSPPPYEE (SEQ ID NO: 196)

12. QSIKAFPIVINSDG (SEQ ID NO: 197)

13. SREKPYKEVTEDLLHLNSL (SEQ ID NO: 185)

14. AAGAYDPARKLLEQYAKK (SEQ ID NO: 170)

15. PNCFNSSINNIHEMEIQLKDALEKNQQWLVYDQQREVYVKGLLAKIF
ELEKKTETAAHSLPQQTKKPESEGYLQEEKQKC (SEQ ID NO: 171)

16. RKSPTPSAPVPLTEPAAQ (SEQ ID NO: 305)

17. (M)SLYPSLEDLKVDKVIQAQTAFSANPANPAILSEASAPIPHDGNL
YPRLYPELSQYMGLSLN (SEQ ID NO: 306)

Based on the disclosure herein, it is well within the level of those of skill in the art to identify L domains suitable for use in producing the multimeric assemblies of the invention. As described elsewhere in this application, an L domain for use in the present invention can be any suitable polypeptide domain that is capable of effecting membrane scission and release of an enveloped multimeric assembly from a cell by recruiting the ESCRT machinery to the site of budding by binding to one or more ESCRT proteins directly or indirectly via any suitable mechanism, including but not limited to non-covalently or covalently. As will be known to those with skill in the art, the ability of an L domain to recruit the ESCRT machinery and effect membrane scission and release of an enveloped multimeric assembly can be assessed using budding assays. In the budding assay, a candidate L domain is genetically fused to a viral structural protein that has been rendered defective in budding by mutation or deletion of its late domain, and the ability of the candidate L domain to restore budding of virus-like particles is evaluated by analyzing the culture supernatant for the presence of the viral structural protein using standard techniques such as SDS-PAGE and Western blotting (Parent L J, Bennett R P, Craven R C, Nelle T D, Krishna N K, Bowzard J B, Wilson C B, Puffer B A, Montelaro R C, Wills J W (1995) Positionally independent and exchangeable late budding functions of the Rous Sarcoma Virus and Human Immunodeficiency Virus Gag proteins. J. Virol. 69:5455-5460). Any viral structural protein that is known to be defective in budding can be used in the budding assay, including but not limited to budding-defective versions of HIV-1 Gag, RSV Gag, MuMoLV Gag, SV5 M, Ebola VP40 and other structural proteins from different families of enveloped viruses including retroviruses, filoviruses, rhabdoviruses, arenaviruses, and paramyxoviruses. In addition, as the inventors describe below, the multimeric assemblies of the invention can be used to test the ability of an L domain to effect membrane scission and release of an enveloped multimeric assembly in a similar manner. The L domain of an enveloped multimeric assembly can be replaced with a candidate L domain, and the ability of the resulting construct to be released from cells can be determined by analyzing the culture supernatant for the presence of the protein subunits of the multimeric assembly using standard techniques such as SDS-PAGE and Western blotting. Finally, as will be known to those with skill in the art, the ability of an L domain to bind to one or more ESCRT proteins directly or indirectly can be assessed using a variety of biochemical, biophysical, and cell biological techniques including but not limited to co-immunoprecipitation, pull-down assays, isothermal titration calorimetry, biosensor binding assays, NMR spectroscopy, and X-ray crystallography.

In a further embodiment, the multimeric assembly of any embodiment or combination of embodiments may further comprise a packaging moiety. As used herein, a "packaging moiety" may be any moiety capable of interacting with a desired "cargo", with the effect of recruiting the cargo to the multimeric assembly. The interaction between the packaging moiety and the cargo can be any type of interaction, covalent or non-covalent, that results in effective interaction with and recruitment to the multimeric assembly. As will be apparent to those of skill in the art, the ability to widely modify surface amino acid residues without disruption of the protein structure permits many types of modifications to endow the resulting self-assembled multimers with a variety of functions. In one non-limiting example, the protein, first protein, and/or second protein can be modified, such as by introduction of various cysteine residues or non-canonical amino acids at defined positions to facilitate linkage to one or more cargo of interest. In another non-limiting example, the protein may be modified to comprise as a genetic fusion a polypeptide domain or sequence known to interact with a desired cargo covalently or non-covalently. In one embodiment, a non-canonical amino acid can be incorporated recombinantly using amber codon suppression (see L. Wang, A. Brock, B. Herberich, P. G. Schultz, Science 292, 498 (2001)). In another embodiment, the packaging moiety comprises the polypeptide sequence:

(SEQ ID NO: 186)
QSRPEPTAPPEESFRSGVETTTPPQKQEPIDKELYPLTSLRSLFGNDPSS

Q, wherein the packaging moiety polypeptide is expressed as a genetic fusion with the M domain, the L domain, or the O interface. This sequence is the p6 domain of HIV Gag, which is known to interact with the HIV protein Vpr (SEQ ID NO: 202) via a non-covalent protein-protein interaction (Cavrois M, et al. (2002) Nat. Biotech. 20:1151-4). By including SEQ ID NO: 186 in a multimeric assembly of the invention, any polypeptide sequence or other molecule that is fused, tethered, or otherwise connected to the Vpr sequence can be packaged into the multimeric assembly.

Additional packaging moieties may comprise or consist of one or more of the following peptides expressed as a genetic fusion with the M domain, the L domain, or the 0 interface, each of which binds to corresponding recognition sequences present in a nucleic acid cargo of interest, resulting in recruitment of the nucleic acid cargo of interest to the multimeric assembly.

(SEQ ID NO: 198)
(a)DRRRRGSRPSGAERRRRRAAAA (1g70), (SEQ ID NO: 199)
(b)AVPETRPNHTIYINNLNEKIKKDELKKSLHAIFSRFGQILDILVSRSL

FKMRGQAFVIKEVSSATNALRSMQGFPFYDKPMRIQYAKTDSDIIAKMK (u1a)

(SEQ ID NO: 200)
(c)(M)QKGNFRNQRKTVKCFNCGKEGHIAKNCRAPRKKGCWKCGKEGHQM

KDCTERQAN (HIV_NC), and/or (SEQ ID NO: 201)
(d)RPRGTRGKGRRIRR (mnb)

In another embodiment, the multimeric assembly further comprises a cargo that interacts with the packaging moiety. Such a "cargo" may be anything of interest that can be linked to or interact with the packaging domain and thus recruited to the multimeric assembly, including but not limited to therapeutics, diagnostics, antigens, adjuvants, imaging agents, dyes, radioisotopes, etc. Alternatively, if the cargo is a protein or polypeptide, the cargo can be expressed as a genetic fusion with the M domain, the L domain, or the O interface in order to directly incorporate the cargo into the multimeric assembly without the use of a distinct packaging domain. In various embodiments, the cargo may be selected from the group consisting of proteins, nucleic acids, lipids, and small organic compounds. In various non-limiting embodiments, the cargo comprises a polypeptide with an amino acid sequence:

(SEQ ID NO: 202)
EQAPEDQGPQREPHNEWTLELLEELKREAVRHFPRPWLHGLGQHIYETYG

DTWAGVEAIIRILQQLLFIHFRIGCQHSRIGIIQQRRARRNGASRS, which is the Vpr protein from HIV, and known to interact with the p6 domain of HIV Gag as described above. An exemplary cargo comprising the Vpr protein comprises or consists of BlaM-Vpr, the packaging of which is described in the examples that follow:

(SEQ ID NO: 203)
(M)SIQHFRVALIPFFAAFCLPVFAHPETLVKVKDAEDQLGARVGYIELD

LNSGKILESFRPEERFPMMSTFKVLLCGAVLSRIDAGQEQLGRRIHYSQN

DLVEYSPVTEKHLTDGMTVRELCSAAITMSDNTAANLLLTTIGGPKELTA

FLHNMGDHVTRLDRWEPELNEAIPNDERDTTMPVAMATTLRKLLTGELLT

LASRQQLIDWMEADKVAGPLLRSALPAGWFIADKSGAGERGSRGIIAALG

PDGKPSRIVVIYTTGSQATMDERNRQIAEIGASLIKHWGSEQAPEDQGPQ

REPHNEWTLELLEELKREAVRHFPRPWLHGLGQHIYETYGDTWAGVEAII

RILQQLLFIHFRIGCQHSRIGIIQQRRARRNGASRS.

In various further embodiments, the cargo comprises a polynucleotide with a nucleic acid sequence selected from the following sequences, which are recognition sequences known to bind to the corresponding polypeptide packaging domains described above, the packaging of which is described in the examples that follow.

(SEQ ID NO: 204)
GGUCUGGGCGCACUUCGGUGACGGUACAGGCC (1g70 RNA sequence)

(SEQ ID NO: 205)
AAUCCAUUGCACUCCGGAUUU (u1a RNA sequence)

(SEQ ID NO: 206)
GGCGACUGGUGAGUACGCCAAAAAUUUUGACUAGCGGAGGCUAG (HIV_NC RNA sequence)

(SEQ ID NO: 207)
GGCUCGUGUAGCUCAUUAGCUCCGAGCC (1mnb RNA sequence)

In various further embodiments, the cargo comprises a nucleic acid comprising one or more of these recognition sequences. Exemplary such mRNAs include the following nucleic acid sequences, each of which has been shown to interact with a multimeric assembly as disclosed in the examples that follow; the underlined portions of these sequence encode the (optional) N-terminal methionines and epitope tags (FLAG or myc, as denoted by construct name). The RNA recognition sequences for cargo packaging at the 5' and 3' end of each sequence are bolded.

FLAG-blaM-1g70: (SEQ ID NO: 208)
GGUCUGGGCGCACUUCGGUGACGGUACAGGCCUAGGAUUACUGCUCGGUGA
CUUAUAAUCAUCCUCCCCGCCACC<u>AUGGACUACAAAGACGACGAUGACAAA</u>
<u>GGUUC</u>UGACCCAGAAACGCUGGUGAAAGUAAAAGAUGCUGAAGAUCAGUUG
GGUGCACGAGUGGGUUACAUCGAACUGGAUCUCAACAGCGGUAAGAUCCUU
GAGAGUUUUCGCCCCGAAGAACGUUUUCCAAUGAUGAGCACUUUUAAAGUU
CUGCUAUGUGGCGCGGUAUUAUCCCGUAUUGACGCCGGGCAAGAGCAACUC
GGUCGCCGCAUACACUAUUCUCAGAAUGACUUGGUUGAGUACUCACCAGUC
ACAGAAAAGCAUCUUACGGAUGGCAUGACAGUAAGAGAAUUAUGCAGUGCU
GCCAUAACCAUGAGUGAUAACACUGCGGCCAACUUACUUCUGACAACGAUC
GGAGGACCGAAGGAGCUAACCGCUUUUUUGCACAACAUGGGGGAUCAUGUA
ACUCGCCUUGAUCGUUGGGAACCGGAGCUGAAUGAAGCCAUACCAAACGAC
GAGCGUGACACCACGAUGCCUGUAGCAAUGGCAACAACGUUGCGCAAACUA
UUAACUGGCGAACUACUUACUCUAGCUUCCCGGCAACAAUUAAUAGACUGG
AUGGAGGCGGAUAAAGUUGCAGGACCACUUCUGCGCUCGGCCCUUCCGGCU
GGCUGGUUUAUUGCUGAUAAAUCUGGAGCCGGUGAGCGUGGGUCUCGCGGU
AUCAUUGCAGCACUGGGGCCAGAUGGUAAGCCCUCCCGUAUCGUAGUUAUC
UACACGACGGGGAGUCAGGCAACUAUGGAUGAACGAAAUAGACAGAUCGCU
GAGAUAGGUGCCUCACUGAUUAAGCAUUGGUAACGAGCACACAUCCUAUUU
GGGCCUAGCAACCAACAGUAUGGGUCUGGGCGCACUUCGGUGACGGUACAG
GCC;

FLAG-blaM-u 1a: (SEQ ID NO: 209)
AAUCCAUUGCACUCCGGAUUUUAGGAUUACUGCUCGGUGACUUAUAAUCAU
CCUCCCCGCCACC<u>AUGGACUACAAAGACGACGAUGACAAA</u>GGUUCUGACCC
AGAAACGCUGGUGAAAGUAAAAGAUGCUGAAGAUCAGUUGGGUGCACGAGU
GGGUUACAUCGAACUGGAUCUCAACAGCGGUAAGAUCCUUGAGAGUUUUCG
CCCCGAAGAACGUUUUCCAAUGAUGAGCACUUUUAAAGUUCUGCUAUGUGG
CGCGGUAUUAUCCCGUAUUGACGCCGGGCAAGAGCAACUCGGUCGCCGCAU
ACACUAUUCUCAGAAUGACUUGGUUGAGUACUCACCAGUCACAGAAAAGCA
UCUUACGGAUGGCAUGACAGUAAGAGAAUUAUGCAGUGCUGCCAUAACCAU
GAGUGAUAACACUGCGGCCAACUUACUUCUGACAACGAUCGGAGGACCGAA
GGAGCUAACCGCUUUUUUGCACAACAUGGGGGAUCAUGUAACUCGCCUUGA
UCGUUGGGAACCGGAGCUGAAUGAAGCCAUACCAAACGACGAGCGUGACAC
CACGAUGCCUGUAGCAAUGGCAACAACGUUGCGCAAACUAUUAACUGGCGA
ACUACUUACUCUAGCUUCCCGGCAACAAUUAAUAGACUGGAUGGAGGCGGA
UAAAGUUGCAGGACCACUUCUGCGCUCGGCCCUUCCGGCUGGCUGGUUUAU
UGCUGAUAAAUCUGGAGCCGGUGAGCGUGGGUCUCGCGGUAUCAUUGCAGC -continued

ACUGGGGCCAGAUGGUAAGCCCUCCCGUAUCGUAGUUAUCUACACGACGGG

GAGUCAGGCAACUAUGGAUGAACGAAAUAGACAGAUCGCUGAGAUAGGUGC

CUCACUGAUUAAGCAUUGGUAACGAGCACACAUCCUAUUUGGGCCUAGCAA

CCAACAGUAUGAAUCCAUUGCACUCCGGAUUU;

FLAG-blaM-HIV NC: (SEQ ID NO: 210)
GGCGACUGGUGAGUACGCCAAAAAUUUUGACUAGCGGAGGCUAGUAGGAUU ACUGCUCGGUGACUUAUAAUCAUCCUCCCCGCCACC<u>AUGGACUACAAAGAC GACGAUGACAAAGGUUCUG</u>ACCCAGAAACGCUGGUGAAAGUAAAAGAUGCU

GAAGAUCAGUUGGGUGCACGAGUGGGUUACAUCGAACUGGAUCUCAACAGC

GGUAAGAUCCUUGAGAGUUUUCGCCCCGAAGAACGUUUUCCAAUGAUGAGC

ACUUUUAAAGUUCUGCUAUGUGGCGCGGUAUUAUCCCGUAUUGACGCCGGG

CAAGAGCAACUCGGUCGCCGCAUACACUAUUCUCAGAAUGACUUGGUUGAG

UACUCACCAGUCACAGAAAAGCAUCUUACGGAUGGCAUGACAGUAAGAGAA

UUAUGCAGUGCUGCCAUAACCAUGAGUGAUAACACUGCGGCCAACUUACUU

CUGACAACGAUCGGAGGACCGAAGGAGCUAACCGCUUUUUUGCACAACAUG

GGGGAUCAUGUAACUCGCCUUGAUCGUUGGGAACCGGAGCUGAAUGAAGCC

AUACCAAACGACGAGCGUGACACCACGAUGCCUGUAGCAAUGGCAACAACG

UUGCGCAAACUAUUAACUGGCGAACUACUUACUCUAGCUUCCCGGCAACAA

UUAAUAGACUGGAUGGAGGCGGAUAAAGUUGCAGGACCACUUCUGCGCUCG

GCCCUUCCGGCUGGCUGGUUUAUUGCUGAUAAAUCUGGAGCCGGUGAGCGU

GGGUCUCGCGGUAUCAUUGCAGCACUGGGGCCAGAUGGUAAGCCCUCCCGU

AUCGUAGUUAUCUACACGACGGGGAGUCAGGCAACUAUGGAUGAACGAAAU

AGACAGAUCGCUGAGAUAGGUGCCUCACUGAUUAAGCAUUGGUAACGAGCA

CACAUCCUAUUUGGGCCUAGCAACCAACAGUAU**GGGCGACUGGUGAGUACG

CCAAAAAUUUUGACUAGCGGAGGCUAG**;

FLAG-blaM-1mnb: (SEQ ID NO: 211)
GGCUCGUGUAGCUCAUUAGCUCCGAGCCUAGGAUUACUGCUCGGUGACUUA UAAUCAUCCUCCCCGCCACC<u>AUGGACUACAAAGACGACGAUGACAAAGGUU CUG</u>ACCCAGAAACGCUGGUGAAAGUAAAAGAUGCUGAAGAUCAGUUGGGUG

CACGAGUGGGUUACAUCGAACUGGAUCUCAACAGCGGUAAGAUCCUUGAGA

GUUUUCGCCCCGAAGAACGUUUUCCAAUGAUGAGCACUUUUAAAGUUCUGC

UAUGUGGCGCGGUAUUAUCCCGUAUUGACGCCGGGCAAGAGCAACUCGGUC

GCCGCAUACACUAUUCUCAGAAUGACUUGGUUGAGUACUCACCAGUCACAG

AAAAGCAUCUUACGGAUGGCAUGACAGUAAGAGAAUUAUGCAGUGCUGCCA

UAACCAUGAGUGAUAACACUGCGGCCAACUUACUUCUGACAACGAUCGGAG

GACCGAAGGAGCUAACCGCUUUUUUGCACAACAUGGGGGAUCAUGUAACUC

GCCUUGAUCGUUGGGAACCGGAGCUGAAUGAAGCCAUACCAAACGACGAGC

GUGACACCACGAUGCCUGUAGCAAUGGCAACAACGUUGCGCAAACUAUUAA

CUGGCGAACUACUUACUCUAGCUUCCCGGCAACAAUUAAUAGACUGGAUGG

AGGCGGAUAAAGUUGCAGGACCACUUCUGCGCUCGGCCCUUCCGGCUGGCU

GGUUUAUUGCUGAUAAAUCUGGAGCCGGUGAGCGUGGGUCUCGCGGUAUCA

UUGCAGCACUGGGGCCAGAUGGUAAGCCCUCCCGUAUCGUAGUUAUCUACA

CGACGGGGAGUCAGGCAACUAUGGAUGAACGAAAUAGACAGAUCGCUGAGA

UAGGUGCCUCACUGAUUAAGCAUUGGUAACGAGCACACAUCCUAUUUGGGC

CUAGCAACCAACAGUAUGGGCUCGUGUAGCUCAUUAGCUCCGAGCC;

Myc-blaM-1g70: (SEQ ID NO: 212)
GGUCUGGGCGCACUUCGGUGACGGUACAGGCCUAGGAUUACUGCUCGGUGA CUUAUAAUCAUCCUCCCCGCCACC<u>AUGGAACAGAAACUGAUUAGCGAAGAA GAUCUGGGUUCUG</u>ACCCAGAAACGCUGGUGAAAGUAAAAGAUGCUGAAGAU

CAGUUGGGUGCACGAGUGGGUUACAUCGAACUGGAUCUCAACAGCGGUAAG

AUCCUUGAGAGUUUUCGCCCCGAAGAACGUUUUCCAAUGAUGAGCACUUUU

AAAGUUCUGCUAUGUGGCGCGGUAUUAUCCCGUAUUGACGCCGGGCAAGAG

CAACUCGGUCGCCGCAUACACUAUUCUCAGAAUGACUUGGUUGAGUACUCA

CCAGUCACAGAAAAGCAUCUUACGGAUGGCAUGACAGUAAGAGAAUUAUGC

AGUGCUGCCAUAACCAUGAGUGAUAACACUGCGGCCAACUUACUUCUGACA

ACGAUCGGAGGACCGAAGGAGCUAACCGCUUUUUUGCACAACAUGGGGGAU

CAUGUAACUCGCCUUGAUCGUUGGGAACCGGAGCUGAAUGAAGCCAUACCA

AACGACGAGCGUGACACCACGAUGCCUGUAGCAAUGGCAACAACGUUGCGC

AAACUAUUAACUGGCGAACUACUUACUCUAGCUUCCCGGCAACAAUUAAUA

GACUGGAUGGAGGCGGAUAAAGUUGCAGGACCACUUCUGCGCUCGGCCCUU

CCGGCUGGCUGGUUUAUUGCUGAUAAAUCUGGAGCCGGUGAGCGUGGGUCU

CGCGGUAUCAUUGCAGCACUGGGGCCAGAUGGUAAGCCCUCCCGUAUCGUA

GUUAUCUACACGACGGGGAGUCAGGCAACUAUGGAUGAACGAAAUAGACAG

AUCGCUGAGAUAGGUGCCUCACUGAUUAAGCAUUGGUAACGAGCACACAUC

CUAUUUGGGCCUAGCAACCAACAGUAU**GGGUCUGGGCGCACUUCGGUGACG

GUACAGGCC**;

Myc-blaM-u1a: (SEQ ID NO: 213)
AAUCCAUUGCACUCCGGAUUUAGGAUUACUGCUCGGUGACUUAUAAUCAU CCUCCCCGCCACC<u>AUGGAACAGAAACUGAUUAGCGAAGAAGAUCUGGGUUC UG</u>ACCCAGAAACGCUGGUGAAAGUAAAAGAUGCUGAAGAUCAGUUGGGUGC

ACGAGUGGGUUACAUCGAACUGGAUCUCAACAGCGGUAAGAUCCUUGAGAG

UUUUCGCCCCGAAGAACGUUUUCCAAUGAUGAGCACUUUUAAAGUUCUGCU

AUGUGGCGCGGUAUUAUCCCGUAUUGACGCCGGGCAAGAGCAACUCGGUCG

CCGCAUACACUAUUCUCAGAAUGACUUGGUUGAGUACUCACCAGUCACAGA

AAAGCAUCUUACGGAUGGCAUGACAGUAAGAGAAUUAUGCAGUGCUGCCAU

AACCAUGAGUGAUAACACUGCGGCCAACUUACUUCUGACAACGAUCGGAGG

ACCGAAGGAGCUAACCGCUUUUUUGCACAACAUGGGGGAUCAUGUAACUCG

CCUUGAUCGUUGGGAACCGGAGCUGAAUGAAGCCAUACCAAACGACGAGCG

UGACACCACGAUGCCUGUAGCAAUGGCAACAACGUUGCGCAAACUAUUAAC

UGGCGAACUACUUACUCUAGCUUCCCGGCAACAAUUAAUAGACUGGAUGGA

GGCGGAUAAAGUUGCAGGACCACUUCUGCGCUCGGCCCUUCCGGCUGGCUG

GUUUAUUGCUGAUAAAUCUGGAGCCGGUGAGCGUGGGUCUCGCGGUAUCAU

UGCAGCACUGGGGCCAGAUGGUAAGCCCUCCCGUAUCGUAGUUAUCUACAC

-continued

GACGGGGAGUCAGGCAACUAUGGAUGAACGAAAUAGACAGAUCGCUGAGAU

AGGUGCCUCACUGAUUAAGCAUUGGUAACGAGCACACAUCCUAUUUGGGCC

UAGCAACCAACAGUAUGAAUCCAUUGCACUCCGGAUUU;

Mc-blaM-HIV_NC: (SEQ ID NO: 214)
GGCGACUGGUGAGUACGCCAAAAAUUUUGACUAGCGGAGGCUAGUAGGAUU

ACUGCUCGGUGACUUAUAAUCAUCCUCCCCGCCACCAUGGAACAGAAACUG

AUUAGCGAAGAAGAUCUGGGUUCUGACCCAGAAACGCUGGUGAAAGUAAAA

GAUGCUGAAGAUCAGUUGGGUGCACGAGUGGGUUACAUCGAACUGGAUCUC

AACAGCGGUAAGAUCCUUGAGAGUUUUCGCCCCGAAGAACGUUUUCCAAUG

AUGAGCACUUUUAAAGUUCUGCUAUGUGGCGCGGUAUUAUCCCGUAUUGAC

GCCGGGCAAGAGCAACUCGGUCGCCGCAUACACUAUUCUCAGAAUGACUUG

GUUGAGUACUCACCAGUCACAGAAAAGCAUCUUACGGAUGGCAUGACAGUA

AGAGAAUUAUGCAGUGCUGCCAUAACCAUGAGUGAUAACACUGCGGCCAAC

UUACUUCUGACAACGAUCGGAGGACCGAAGGAGCUAACCGCUUUUUUGCAC

AACAUGGGGGAUCAUGUAACUCGCCUUGAUCGUUGGGAACCGGAGCUGAAU

GAAGCCAUACCAAACGACGAGCGUGACACCACGAUGCCUGUAGCAAUGGCA

ACAACGUUGCGCAAACUAUUAACUGGCGAACUACUUACUCUAGCUUCCCGG

CAACAAUUAAUAGACUGGAUGGAGGCGGAUAAAGUUGCAGGACCACUUCUG

CGCUCGGCCCUUCCGGCUGGCUGGUUUAUUGCUGAUAAAUCGGGAGCCGGU

GAGCGUGGGUCUCGCGGUAUCAUUGCAGCACUGGGGCCAGAUGGUAAGCCC

UCCCGUAUCGUAGUUAUCUACACGACGGGGAGUCAGGCAACUAUGGAUGAA

CGAAAUAGACAGAUCGCUGAGAUAGGUGCCUCACUGAUUAAGCAUUGGUAA

CGAGCACACAUCCUAUUUGGGCCUAGCAACCAACAGUAUGGGCGACUGGUG

AGUACGCCAAAAAUUUUGACUAGCGGAGGCUAG;

Myc-blaM-1mnb: (SEQ ID NO: 215)
GGCUCGUGUAGCUCAUUAGCUCCGAGCCUAGGAUUACUGCUCGGUGACUUA UAAUCAUCCUCCCCGCCACC<u>AUGGAACAGAAACUGAUUAGCGAAGAAGAUC</u>

<u>UGGGUUCUG</u>ACCCAGAAACGCUGGUGAAAGUAAAAGAUGCUGAAGAUCAGU

UGGGUGCACGAGUGGGUUACAUCGAACUGGAUCUCAACAGCGGUAAGAUCC

UUGAGAGUUUUCGCCCCGAAGAACGUUUUCCAAUGAUGAGCACUUUUAAAG

UUCUGCUAUGUGGCGCGGUAUUAUCCCGUAUUGACGCCGGGCAAGAGCAAC

UCGGUCGCCGCAUACACUAUUCUCAGAAUGACUUGGUUGAGUACUCACCAG

UCACAGAAAAGCAUCUUACGGAUGGCAUGACAGUAAGAGAAUUAUGCAGUG

CUGCCAUAACCAUGAGUGAUAACACUGCGGCCAACUUACUUCUGACAACGA

UCGGAGGACCGAAGGAGCUAACCGCUUUUUUGCACAACAUGGGGGAUCAUG

UAACUCGCCUUGAUCGUUGGGAACCGGAGCUGAAUGAAGCCAUACCAAACG

ACGAGCGUGACACCACGAUGCCUGUAGCAAUGGCAACAACGUUGCGCAAAC

UAUUAACUGGCGAACUACUUACUCUAGCUUCCCGGCAACAAUUAAUAGACU

GGAUGGAGGCGGAUAAAGUUGCAGGACCACUUCUGCGCUCGGCCCUUCCGG

CUGGCUGGUUUAUUGCUGAUAAAUCGGGAGCCGGUGAGCGUGGGUCUCGCG

GUAUCAUUGCAGCACUGGGGCCAGAUGGUAAGCCCUCCCGUAUCGUAGUUA

UCUACACGACGGGGAGUCAGGCAACUAUGGAUGAACGAAAUAGACAGAUCG

CUGAGAUAGGUGCCUCACUGAUUAAGCAUUGGUAACGAGCACACAUCCUAU

UUGGGCCUAGCAACCAACAGUAUGGGCUCGUGUAGCUCAUUAGCUCCGAGC

C;

Myc-GFP-1g70: (SEQ ID NO: 216)
GGUCUGGGCGCACUUCGGUGACGGUACAGGCCUAGGAUUACUGCUCGGUGA

CUUAUAAUCAUCCUCCCCGCCACC<u>AUGGAACAGAAACUGAUUAGCGAAGAA</u>

<u>GAUCUGGUGAGC</u>AAGGGCGAGGAGCUGUUCACCGGGGUGGUGCCCAUCCUG

GUCGAGCUGGACGGCGACGUAAACGGCCACAAGUUCAGCGUGUCCGGCGAG

GGCGAGGGCGAUGCCACCUACGGCAAGCUGACCCUGAAGUUCAUCUGCACC

ACCGGCAAGCUGCCCGUGCCCUGGCCCACCCUCGUGACCACCCUGACCUAC

GGCGUGCAGUGCUUCAGCCGCUACCCCGACCACAUGAAGCAGCACGACUUC

UUCAAGUCCGCCAUGCCCGAAGGCUACGUCCAGGAGCGCACCAUCUUCUUC

AAGGACGACGGCAACUACAAGACCCGCGCCGAGGUGAAGUUCGAGGGCGAC

ACCCUGGUGAACCGCAUCGAGCUGAAGGGCAUCGACUUCAAGGAGGACGGC

AACAUCCUGGGGCACAAGCUGGAGUACAACUACAACAGCCACAACGUCUAU

AUCAUGGCCGACAAGCAGAAGAACGGCAUCAAGGUGAACUUCAAGAUCCGC

CACAACAUCGAGGACGGCAGCGUGCAGCUCGCCGACCACUACCAGCAGAAC

ACCCCCAUCGGCGACGGCCCCGUGCUGCUGCCCGACAACCACUACCUGAGC

ACCCAGUCCGCCCUGAGCAAAGACCCCAACGAGAAGCGCGAUCACAUGGUC

CUGCUGGAGUUCGUGACCGCCGCCGGGAUCACUCUCGGCAUGGACGAGCUG

UACAAGUAACGAGCACACAUCCUAUUUGGGCCUAGCAACCAACAGUAUGGG

UCUGGGCGCACUUCGGUGACGGUACAGGCC;

Myc -GFP-u1a (SEQ ID NO: 217)
AAUCCAUUGCACUCCGGAUUUUAGGAUUACUGCUCGGUGACUUAUAAUCAU

CCUCCCCGCCACC<u>AUGGAACAGAAACUGAUUAGCGAAGAAGAUCUGGUGAG</u>

<u>C</u>AAGGGCGAGGAGCUGUUCACCGGGGUGGUGCCCAUCCUGGUCGAGCUGGA

CGGCGACGUAAACGGCCACAAGUUCAGCGUGUCCGGCGAGGGCGAGGGCGA

UGCCACCUACGGCAAGCUGACCCUGAAGUUCAUCUGCACCACCGGCAAGCU

GCCCGUGCCCUGGCCCACCCUCGUGACCACCCUGACCUACGGCGUGCAGUG

CUUCAGCCGCUACCCCGACCACAUGAAGCAGCACGACUUCUUCAAGUCCGC

CAUGCCCGAAGGCUACGUCCAGGAGCGCACCAUCUUCUUCAAGGACGACGG

CAACUACAAGACCCGCGCCGAGGUGAAGUUCGAGGGCGACACCCUGGUGAA

CCGCAUCGAGCUGAAGGGCAUCGACUUCAAGGAGGACGGCAACAUCCUGGG

GCACAAGCUGGAGUACAACUACAACAGCCACAACGUCUAUAUCAUGGCCGA

CAAGCAGAAGAACGGCAUCAAGGUGAACUUCAAGAUCCGCCACAACAUCGA

GGACGGCAGCGUGCAGCUCGCCGACCACUACCAGCAGAACACCCCCAUCGG

CGACGGCCCCGUGCUGCUGCCCGACAACCACUACCUGAGCACCCAGUCCGC

CCUGAGCAAAGACCCCAACGAGAAGCGCGAUCACAUGGUCCUGCUGGAGUU

CGUGACCGCCGCCGGGAUCACUCUCGGCAUGGACGAGCUGUACAAGUAAGC

UCCACACAUCCUAUUUGGGCCUAGCAACCAACAGUAUGAAUCCAUUGCACU

CCGGAUUU;

Mc-GFP-HIV_NC; (SEQ ID NO: 218)
GGCGACUGGUGAGUACGCCAAAAAUUUUGACUAGCGGAGGCUAGUAGGAUU

ACUGCUCGGUGACUUAUAAUCAUCCUCCCCGCCACC<u>AUGGAACAGAAACUG</u>

<u>AUUAGCGAAGAAGAUCUGGUGAGC</u>AAGGGCGAGGAGCUGUUCACCGGGGUG

GUGCCCAUCCUGGUCGAGCUGGACGGCGACGUAAACGGCCACAAGUUCAGC

GUGUCCGGCGAGGGCGAGGGCGAUGCCACCUACGGCAAGCUGACCCUGAAG

UUCAUCUGCACCACCGGCAAGCUGCCCGUGCCCUGGCCCACCCUCGUGACC

ACCCUGACCUACGGCGUGCAGUGCUUCAGCCGCUACCCCGACCACAUGAAG

CAGCACGACUUCUUCAAGUCCGCCAUGCCCGAAGGCUACGUCCAGGAGCGC

ACCAUCUUCUUCAAGGACGACGGCAACUACAAGACCCGCGCCGAGGUGAAG

UUCGAGGGCGACACCCUGGUGAACCGCAUCGAGCUGAAGGGCAUCGACUUC

AAGGAGGACGGCAACAUCCUGGGGCACAAGCUGGAGUACAACUACAACAGC

CACAACGUCUAUAUCAUGGCCGACAAGCAGAAGAACGGCAUCAAGGUGAAC

UUCAAGAUCCGCCACAACAUCGAGGACGGCAGCGUGCAGCUCGCCGACCAC

UACCAGCAGAACACCCCCAUCGGCGACGGCCCCGUGCUGCUGCCCGACAAC

CACUACCUGAGCACCCAGUCCGCCCUGAGCAAAGACCCCAACGAGAAGCGC

GAUCACAUGGUCCUGCUGGAGUUCGUGACCGCCGCCGGGAUCACUCUCGGC

AUGGACGAGCUGUACAAGUAACAGCCACACAUCCUAUUUGGGCCUAGCAAC

CAACAGUAUGGGCGACUGGUGAGUACGCCAAAAAUUUUGACUAGCGGAGGC

UAG;
and

Myc-GFP-1mnb: (SEQ ID NO: 219)
GGCUCGUGUAGCUCAUUAGCUCCGAGCCUAGGAUUACUGCUCGGUGACUUA UAAUCAUCCUCCCCGCCACC<u>AUGGAACAGAAACUGAUUAGCGAAGAAGAUC</u>

<u>UGGUGAGC</u>AAGGGCGAGGAGCUGUUCACCGGGGUGGUGCCCAUCCUGGUCG

AGCUGGACGGCGACGUAAACGGCCACAAGUUCAGCGUGUCCGGCGAGGGCG

AGGGCGAUGCCACCUACGGCAAGCUGACCCUGAAGUUCAUCUGCACCACCG

GCAAGCUGCCCGUGCCCUGGCCCACCCUCGUGACCACCCUGACCUACGGCG

UGCAGUGCUUCAGCCGCUACCCCGACCACAUGAAGCAGCACGACUUCUUCA

AGUCCGCCAUGCCCGAAGGCUACGUCCAGGAGCGCACCAUCUUCUUCAAGG

ACGACGGCAACUACAAGACCCGCGCCGAGGUGAAGUUCGAGGGCGACACCC

UGGUGAACCGCAUCGAGCUGAAGGGCAUCGACUUCAAGGAGGACGGCAACA

UCCUGGGGCACAAGCUGGAGUACAACUACAACAGCCACAACGUCUAUAUCA

UGGCCGACAAGCAGAAGAACGGCAUCAAGGUGAACUUCAAGAUCCGCCACA

ACAUCGAGGACGGCAGCGUGCAGCUCGCCGACCACUACCAGCAGAACACCC

CCAUCGGCGACGGCCCCGUGCUGCUGCCCGACAACCACUACCUGAGCACCC

AGUCCGCCCUGAGCAAAGACCCCAACGAGAAGCGCGAUCACAUGGUCCUGC

UGGAGUUCGUGACCGCCGCCGGGAUCACUCUCGGCAUGGACGAGCUGUACA

AGUAAGUCGCACACAUCCUAUUUGGGCCUAGCAACCAACAGUAUGGGCUCG

UGUAGCUCAUUAGCUCCGAGCC.

The following represent exemplary proteins that would result from translation of the exemplified packaged mRNAs disclosed above (which represent 3 proteins encoded by 4 distinct mRNAs, each incorporating a distinct recognition sequence):

FLAG-BlaM (SEQ ID NO: 220)
(M)DYKDDDDK)GSDPETLVKVKDAEDQLGARVGYIELDLNSGKILESFRP

EERFPMMSTFKVLLCGAVLSRIDAGQEQLGRRIHYSQNDLVEYSPVTEKHL

TDGMTVRELCSAAITMSDNTAANLLLTTIGGPKELTAFLHNMGDHVTRLDR

WEPELNEAIPNDERDTTMPVAMATTLRKLLTGELLTLASRQQLIDWMEADK

VAGPLLRSALPAGWFIADKSGAGERGSRGIIAALGPDGKPSRIVVIYTTGS

QATMDERNRQIAEIGASLIKHW

Myc-BlaM (SEQ ID NO: 221)
(M)E(QKLISEEDL)GSDPETLVKVKDAEDQLGARVGYIELDLNSGKILES

FRPEERFPMMSTFKVLLCGAVLSRIDAGQEQLGRRIHYSQNDLVEYSPVTE

KHLTDGMTVRELCSAAITMSDNTAANLLLTTIGGPKELTAFLHNMGDHVTR

LDRWEPELNEAIPNDERDTTMPVAMATTLRKLLTGELLTLASRQQLIDWME

ADKVAGPLLRSALPAGWFIADKSGAGERGSRGIIAALGPDGKPSRIVVIYT

TGSQATMDERNRQIAEIGASLIKHW

Myc-GFP (SEQ ID NO: 222)
(M)E(QKLISEEDL)VSKGEELFTGVVPILVELDGDVNGHKFSVSGEGEGD

ATYGKLTLKFICTTGKLPVPWPTLVTTLTYGVQCFSRYPDHMKQHDFFKSA

MPEGYVQERTIFFKDDGNYKTRAEVKFEGDTLVNRIELKGIDFKEDGNILG

HKLEYNYNSHNVYIMADKQKNGIKVNFKIRHNIEDGSVQLADHYQQNTPIG

DGPVLLPDNHYLSTQSALSKDPNEKRDHMVLLEFVTAAGITLGMDELYK

As will be understood by those of skill in the art, the M and L domains, and O interfaces (and the packaging moiety in appropriate embodiments) may be contiguous in each protein, or may be separated by linker peptides as deemed appropriate. Any suitable linker may be used as deemed appropriate for an intended multimeric structure. In various non-limiting embodiments, the linkers may comprise or consist of one or more of the polypeptide sequences GSGS (SEQ ID NO: 223); GSDGSGRSGS(SEQ ID NO: 224); GSKSGSGSDSGS (SEQ ID NO: 225); and/or GSGSGDG-GRGSRGGDGSGGSSG (SEQ ID NO: 226).

As will further be understood by those of skill in the art, any suitable combination of M and L domains and O interfaces (and packaging moiety and linkers in appropriate embodiments) may be used to produce the protein that assembles to form an intended multimeric assembly of the invention. In various non-limiting embodiments the protein may comprise or consist of one of the following proteins, several of which are described in more detail in the examples that follow:

(Myr-I3-01-myc-p6)

SEQ ID: 227

(M)GARASGSKSGSGSDSGSKMEELFKKHKIVAVLRANSVEEAKKKALAVFLGGVH

LIEITFTVPDADTVIKELSFLKEMGAIIGAGTVTSVEQCRKAVESGAEFIVSPHLDEEIS

QFCKEKGVFYMPGVMTPTELVKAMKLGHTILKLFPGEVVGPQFVKAMKGPFPNVKF

VPTGGVNLDNVCEWFKAGVLAVGVGSALVKGTPVEVAEKAKAFVEKIRGCTE(QKL

ISEEDL)QSRPEPTAPPEESFRSGVETTTPPQKQEPIDKELYPLTSLRSLFGNDPSSQ

Standard font: O interface
Bold and underlined = M domain
Underlined only = L domain
Bold font only = linker
(Late2-4GS-I3-01-10GS-PH-flag)

SEQ ID: 228

(M)VRRVILPTAPPEYMEATYPVRGSGSKMEELFKKHKIVAVLRANSVEEAKKKALA

VFLGGVHLIEITFTVPDADTVIKELSFLKEMGAIIGAGTVTSVEQCRKAVESGAEFIVS

PHLDEEISQFCKEKGVFYMPGVMTPTELVKAMKLGHTILKLFPGEVVGPQFVKAMK

GPFPNVKFVPTGGVNLDNVCEWFKAGVLAVGVGSALVKGTPVEVAEKAKAFVEKI

RGCTEGSDGSGRSGSHGLQDDPDLQALLKGSQLLKVKSSSWRRERFYKLQEDC

KTIWQESRKVMRSPESQLFSIEDIQEVRMGHRTEGLEKFARDIPEDRCFSIVFKD

QRNTLDLIAPSPADAQHWVQGLRKIIHHSGSMDQRQK(DYKDDDDK)GS

Myr-I3-01-posT1-myc-p6

(SEQ ID NO: 229)

(M)GARASGSKSGSGSDSGSKMEELFKKHKIVAVLRANSVEEAKKKALAVFLGGVHLIEITF

TVPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLKNVCKW

FKAGVLAVGVGKALVKGTPVEVAKKAKAFVKKIRGCTE(QKLISEEDL)QSRPEPTAPPEESF

RSGVETTTPPQKQEPIDKELYPLTSLRSLFGNDPSSQ

Myr1-12GS-I3-01(M3I)-myc-Late1(EPN-01)

(SEQ ID NO: 230)

(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)QSRPEPTAPPEESFR

SGVETTTPPQKQEPIDKELYPLTSLRSLFGNDPSSQ

Myr2-12G5-I3-01(M3I)-myc-Late1 (EPN-03)

(SEQ ID NO: 231)

(M)GAQFSGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)QSRPEPTAPPEESFR

SGVETTTPPQKQEPIDKELYPLTSLRSLFGNDPSSQ

Palm1-12GS-I3-01(M3I)-myc-Late1 (EPN-07)

(SEQ ID NO: 232)

(M)GCIKSKRKDNLNGSKSGSGSDSGSKIEELFKKHKIVAVLRANSVEEAKKKALAVFLGGV

HLIEITFTVPDADTVIKELSFLKEMGAIIGAGTVTSVEQCRKAVESGAEFIVSPHLDEEISQFCK

EKGVFYMPGVMTPTELVKAMKLGHTILKLFPGEVVGPQFVKAMKGPFPNVKFVPTGGVNLD

NVCEWFKAGVLAVGVGSALVKGTPVEVAEKAKAFVEKIRGCTE(QKLISEEDL)QSRPEPTAP

PEESFRSGVETTTPPQKQEPIDKELYPLTSLRSLFGNDPSSQ

Palm2-12GS-I3-01(M3I)-myc-Late1 (EPN-08)

-continued (SEQ ID NO: 233)
(M)GCTLSAEERAALGSKSGSGSDSGSKIEELFKKHKIVAVLRANSVEEAKKKALAVFLGGV

HLIEITFTVPDADTVIKELSFLKEMGAIIGAGTVTSVEQCRKAVESGAEFIVSPHLDEEISQFCK

EKGVFYMPGVMTPTELVKAMKLGHTILKLFPGEVVGPQFVKAMKGPFPNVKFVPTGGVNLD

NVCEWFKAGVLAVGVGSALVKGTPVEVAEKAKAFVEKIRGCTE(QKLISEEDL)QSRPEPTAP

PEESFRSGVETTTPPQKQEPIDKELYPLTSLRSLFGNDPSSQ

Palm3-12GS-I3-01(M3I)-myc-Late1 (EPN-09)

(SEQ ID NO: 234)
(M)LCCMRRTKQVEKGSKSGSGSDSGSKIEELFKKHKIVAVLRANSVEEAKKKALAVFLGG

VHLIEITFTVPDADTVIKELSFLKEMGAIIGAGTVTSVEQCRKAVESGAEFIVSPHLDEEISQFC

KEKGVFYMPGVMTPTELVKAMKLGHTILKLFPGEVVGPQFVKAMKGPFPNVKFVPTGGVNL

DNVCEWFKAGVLAVGVGSALVKGTPVEVAEKAKAFVEKIRGCTE(QKLISEEDL)QSRPEPTA

PPEESFRSGVETTTPPQKQEPIDKELYPLTSLRSLFGNDPSSQ

Palm1-Late1-I3-01(M3I)-myc (EPN-11)

(SEQ ID NO: 235)
(M)GCIKSKRKDNLNLQSRPEPTAPPEESFRSGVETTTPPQKQEPIDKELYPLTSLRSLFGNDPS

SQKIEELFKKHKIVAVLRANSVEEAKKKALAVFLGGVHLIEITFTVPDADTVIKELSFLKEMG

AIIGAGTVTSVEQCRKAVESGAEFIVSPHLDEEISQFCKEKGVFYMPGVMTPTELVKAMKLG

HTILKLFPGEVVGPQFVKAMKGPFPNVKFVPTGGVNLDNVCEWFKAGVLAVGVGSALVKG

TPVEVAEKAKAFVEKIRGCTE(QKLISEEDL)

PH-4GS-I3-01(M3I)-myc-Late1 (EPN-18)

(SEQ ID NO: 236)
(M)HGLQDDPDLQALLKGSQLLKVKSSSWRRERFYKLQEDCKTIWQESRKVMRSPESQ

LFSIEDIQEVRMGHRTEGLEKFARDIPEDRCFSIVFKDQRNTLDLIAPSPADAQHWVQGL

RKIIHHSGSMDQRQKGSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)QSRPEPTAPPEESFR

SGVETTTPPQKQEPIDKELYPLTSLRSLFGNDPSSQ

Late2-4GS-I3-01(M3I)-myc-PH (EPN-20)

(SEQ ID NO: 237)
(M)RRVILPTAPPEYMEATYPVRGSGSKIEELFKKHKIVAVLRANSVEEAKKKALAVFLGGVH

LIEITFTVPDADTVIKELSFLKEMGAIIGAGTVTSVEQCRKAVESGAEFIVSPHLDEEISQFCKE

KGVFYMPGVMTPTELVKAMKLGHTILKLFPGEVVGPQFVKAMKGPFPNVKFVPTGGVNLD

NVCEWFKAGVLAVGVGSALVKGTPVEVAEKAKAFVEKIRGCTE(QKLISEEDL)HGLQDDPD

LQALLKGSQLLKVKSSSWRRERFYKLQEDCKTIWQESRKVMRSPESQLFSIEDIQEVRM

GHRTEGLEKFARDIPEDRCFSIVFKDQRNTLDLIAPSPADAQHWVQGLRKIIHHSGSMD

QRQK

Late1-PH-4GS-I3-01(M3I)-myc (EPN-23)

(SEQ ID NO: 238)
(M)LQSRPEPTAPPEESFRSGVETTTPPQKQEPIDKELYPLTSLRSLFGNDPSSQHGLQDDPDLQ

ALLKGSQLLKVKSSSWRRERFYKLQEDCKTIWQESRKVMRSPESQLFSIEDIQEVRMGH

RTEGLEKFARDIPEDRCFSIVFKDQRNTLDLIAPSPADAQHWVQGLRKIIHHSGSMDQR

QKGSGSKIEELFKKHKIVAVLRANSVEEAKKKALAVFLGGVHLIEITFTVPDADTVIKELSFL

KEMGAIIGAGTVTSVEQCRKAVESGAEFIVSPHLDEEISQFCKEKGVFYMPGVMTPTELVKA

MKLGHTILKLFPGEVVGPQFVKAMKGPFPNVKFVPTGGVNLDNVCEWFKAGVLAVGVGSA

-continued

LVKGTPVEVAEKAKAFVEKIRGCTE(QKLISEEDL)

PH-Late1-I3-01(M3I)-myc(EPN-24)

(SEQ ID NO: 239)

(M)HGLQDDPDLQALLKGSQLLKVKSSSWRRERFYKLQEDCKTIWQESRKVMRSPESQ

LFSIEDIQEVRMGHRTEGLEKFARDIPEDRCFSIVFKDQRNTLDLIAPSPADAQHWVQGL

RKIIHHSGSMDQRQKLQSRPEPTAPPEESFRSGVETTTPPQKQEPIDKELYPLTSLRSLFGNDP

SSQKIEELFKKHKIVAVLRANSVEEAKKKALAVFLGGVHLIEITFTVPDADTVIKELSFLKEMG

AIIGAGTVTSVEQCRKAVESGAEFIVSPHLDEEISQFCKEKGVFYMPGVMTPTELVKAMKLG

HTILKLFPGEVVGPQFVKAMKGPFPNVKFVPTGGVNLDNVCEWFKAGVLAVGVGSALVKG

TPVEVAEKAKAFVEKIRGCTE(QKLISEEDL)

I3-01(M3I)-myc-Late1-PH(EPN-25)

(SEQ ID NO: 240)

(M)KIEELFKKHKIVAVLRANSVEEAKKKALAVFLGGVHLIEITFTVPDADTVIKELSFLKEMG

AIIGAGTVTSVEQCRKAVESGAEFIVSPHLDEEISQFCKEKGVFYMPGVMTPTELVKAMKLG

HTILKLFPGEVVGPQFVKAMKGPFPNVKFVPTGGVNLDNVCEWFKAGVLAVGVGSALVKG

TPVEVAEKAKAFVEKIRGCTE(QKLISEEDL)QSRPEPTAPPEESFRSGVETTTPPQKQEPIDKEL

YPLTSLRSLFGNDPSSQHGLQDDPDLQALLKGSQLLKVKSSSWRRERFYKLQEDCKTIW

QESRKVMRSPESQLFSIEDIQEVRMGHRTEGLEKFARDIPEDRCFSIVFKDQRNTLDLIA

PSPADAQHWVQGLRKIIHHSGSMDQRQK

Myr1-12GS-I3-01(M3I)-myc-Late2(EPN-36)

(SEQ ID NO: 241)

(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)RRVILPTAPPEYME

AIYPVR

Myr1-12GS-I3-01(M3I)-myc-Late3(EPN-37)

(SEQ ID NO: 242)

(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)PIQQKSQHNKSVVQ

ETPQTQNLYPDLSEIKKEYNVKEKDQVEDLNLDSLWE

Myr1-12GS-I3-01(M3I)-myc-Late4(EPN-38)

(SEQ ID NO: 243)

(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)NPRQSIKAFPIVINS

DGGEK

Myr1-12GS-I3-01(M3I)-myc-22GS-Late1(EPN-39)

(SEQ ID NO: 244)

(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)GSGSGDGGRGSRG

GDGSGGSSGLQSRPEPTAPPEESFRSGVETTTPPQKQEPIDKELYPLTSLRSLFGNDPSSQ

-continued

Myr1-12GS-I3-01(M3I)-myc-22GS-Late3(EPN-41)
(SEQ ID NO: 245)
(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)GSGSGDGGRGSRG

GDGSGGSSGPIQQKSQHNKSVVQETPQTQNLYPDLSEIKKEYNVKEKDQVEDLNLDSLWE

Myr1-12GS-I3-01(M3I)-myc-22GS-Late4(EPN-42)
(SEQ ID NO: 246)
(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)GSGSGDGGRGSRG

GDGSGGSSGNPRQSIKAFPIVINSDGGEK

Myr1-12GS-I3-01(M3I)-myc-22GS-Late5(EPN-43)
(SEQ ID NO: 247)
(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)GSGSGDGGRGSRG

GDGSGGSSGPTAPPEYGGS

Myr1-12GS-I3-01(M3I)-myc-22GS-Late6(EPN-44)
(SEQ ID NO: 248)
(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)GSGSGDGGRGSRG

GDGSGGSSGPTAPGGS

Myr1-12GS-I3-01(M3I)-myc-22GS-Late8(EPN-46)
(SEQ ID NO: 249)
(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGP0FVKAMKGPFPNVKFVPTGGVNLDNVCEW

FKAGVLAVGVGSALVKGTPVEVAEKAKAFVEKIRGCTE(QKLISEEDL)GSGSGDGGRGSRG

GDGSGGSSGYPLTSLGGS

Myr1-12GS-I3-01(M3I)-myc-22GS-Late9(EPN-47)
(SEQ ID NO: 250)
(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

FKAGVLAVGVGSALVKGTPVEVAEKAKAFVEKIRGCTE(QKLISEEDL)GSGSGDGGRGSRG

GDGSGGSSGYPDLGGS

Myr1-12GS-I3-01(M3I)-myc-22GS-Late10(EPN-48)
(SEQ ID NO: 251)
(M)GARASGSKSGSGSDSGSKIEELFKKHKIVAVLRANSVEEAKKKALAVFLGGVHLIEITFT

VPDADTVIKELSFLKEMGAIIGAGTVTSVEQCRKAVESGAEFIVSPHLDEEISQFCKEKGVFY

MPGVMTPTELVKAMKLGHTILKLFPGEVVGPQFVKAMKGPFPNVKFVPTGGVNLDNVCEW

```
-continued
FKAGVLAVGVGSALVKGTPVEVAEKAKAFVEKIRGCTE(QKLISEEDL)GSGSGDGGRGSRG

GDGSGGSSGFPIVGGS

Late1-O3-33-myc-PH(EPN-51)
                                                    (SEQ ID NO: 252)
(M)LQSRPEPTAPPEESFRSGVETTTPPQKQEPIDKELYPLTSLRSLFGNDPSSQSQAIGILELTSI

AAGMELGDAMLKSANVDLLVSKTISPGKFLLMLGGDIGAIQQAIETGTSQAGELLVDSLVLA

NIHPSVLPAISGLNSVDKRQAVGIVETWSVAACISAADRAVKGSNVTLVRVHMAFGIGGKCY

MVVAGDVSDVALAVTVASSSAGAYGLLVYASLIPRPHEAMWRQMVEG(QKLISEEDL)HGL

QDDPDLQALLKGSQLLKVKSSSWRRERFYKLQEDCKTIWQESRKVMRSPESQLFSIEDI

QEVRMGHRTEGLEKFARDIPEDRCFSIVFKDQRNTLDLIAPSPADAQHWVQGLRKIIHH

SGSMDQRQK (truncated variant of Myr-I3-01-myc-p6 lacking
N-terminal M domain and linker)
                                                        SEQ ID 317
MEELFKKHKIVAVLRANSVEEAKKKALAVFLGGVHLIEITFTVPDADTVIKELSFLKE

MGAIIGAGTVTSVEQCRKAVESGAEFIVSPHLDEEISQFCKEKGVFYMPGVMTPTELV

KANIKLGHTILKLFPGEVVGPQFVKAMKGPFPNVKFVPTGGVNLDNVCEWFKAGVL

AVGVGSALVKGTPVEVAEKAKAFVEKIRGCTE(QKLISEEDL)QSRPEPTAPPEESFRS

GVETTTPPQKQEPIDKELYPLTSLRSLFGNDPSSQ
```

The following embodiments comprise proteins in which a protein cargo is genetically fused to the protein comprising the M, O, and L domains. As described above, no packaging moiety is required in such embodiments. In one embodiment, the cargo is a detectable protein, such as green fluorescent protein (GFP); this protein forms a fully functional multimeric assembly that is useful for visualizing the subcellular localization of the protein inside the cell in which it is produced and in recipient cells in which the assembly is used as a delivery vehicle. The underlined portion of the protein sequence is the protein cargo.

```
PH-GFP-4GS-I3-01(M3I)-myc-late1("EPN-18-GFP")
                                                    (SEQ ID NO: 253)
(M)HGLQDDPDLQALLKGSQLLKVKSSSWRRERFYKLQEDCKTIWQESRKVMRSPESQLFSI

EDIQEVRMGHRTEGLEKFARDIPEDRCFSIVFKDQRNTLDLIAPSPADAQHWVQGLRKII

HHSGSMDQRQKKGEELFTGVVPILVELDGDVNGHKFSVRGEGEGDATNGKLTLKFICTTG

KLPVPWPTLVTTLTYGVQCFARYPDHMKQHDFFKSAMPEGYVQERTISFKDDGTYKTRAE

VKFEGDTLVNRIELKGIDFKEDGNILGHKLEYNFNSHNVYITADKQKNGIKANFKIRHNV

EDGSVQLADHYQQNTPIGDGPVLLPDNHYLSTQSVLSKDPNEKRDHMVLLEFVTAAGITH

GMDELYGSGSKIEELFKKHKIVAVLRANSVEEAKKKALAVFLGGVHLIEITFTVPDADTV

IKELSFLKEMGAIIGAGTVTSVEQCRKAVESGAEFIVSPHLDEEISQFCKEKGVFYMPGV

MTPTELVKAMKLGHTILKLFPGEVVGPQFVKAMKGPFPNVKFVPTGGVNLDNVCEWFKAG

VLAVGVGSALVKGTPVEVAEKAKAFVEKIRGCTE(QKLISEEDL)QSRPEPTAPPEESFRSG

VETTTPPQKQEPIDKELYPLTSLRSLFGNDPSSQ
```

The following proteins are derived from EPN-01 (SEQ ID NO: 230) or a positively charged variant of Myr-I3-01-myc-p6 (Myr-I3-01-posT1-myc-p6; SEQ ID NO: 229) bearing a genetic fusion to a packaging domain intended to direct the packaging of nucleic acids of interest. For each packaging domain, two constructs were made—a direct genetic fusion and a "frameshift" variant in which the packaging domain should be included in only a fraction of the protein molecules produced due to the presence of a frameshift element in the gene encoding the protein. The frameshift variants are denoted by an "—FS" at the end of their names. A linker is underlined, and the packaging domain includes the residues C-terminal to the underlined linker sequence.

EPN-01-1g70
(SEQ ID NO: 254)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQ<u>GGSKGS</u>DRRRRGSRPSGAERRRRRAAAA;

EPN-01-1g70-FS
(SEQ ID NO: 255)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQGS<u>FFREDLAFLQGKARELGGS</u>KGSDRRRR
GSRPSGAERRRRRAAAA;

EPN-01-posT1-1g70
(SEQ ID NO: 256)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQ<u>GGSKGS</u>DRRRRGSRPSGAERRRRRAA
AA;

EPN-01-posT1-1g70-FS
(SEQ ID NO: 257)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQGS<u>FFREDLAFLQGKARELGGS</u>KGSDRR
RRGSRPSGAERRRRRAAAA;

EPN-01-u1a
(SEQ ID NO: 258)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQ<u>GGSKGS</u>AVPETRPNHTIYINNLNEKIKKD
ELKKSLHAIFSRFGQILDILVSRSLKMRGQAFVIFKEVSSATNALRSMQGFPFYDKPMRIQYAK
TDSDIIAKMK;

EPN-01-u1a-FS (SEQ ID NO: 259)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQGS<u>FFREDLAFLQGKARELGGSKGS</u>AVPET
RPNHTIYINNLNEKIKKDELKKSLHAIFSRFGQILDILVSRSLKMRGQAFVIFKEVSSATNALRS
MQGFPFYDKPMRIQYAKTDSDIIAKMK

>EPN-01-posT1-u1a (SEQ ID NO: 260)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQ<u>GGSKGS</u>AVPETRPNHTIYINNLNEKIKK
DELKKSLHAIFSRFGQILDILVSRSLKMRGQAFVIFKEVSSATNALRSMQGFPFYDKPMRIQYA
KTDSDIIAKMK EPN-01-posT1-u1a-FS (SEQ ID NO: 261)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQGS<u>FFREDLAFLQGKARELGGSKGS</u>AVP
ETRPNHTIYINNLNEKIKKDELKKSLHAIFSRFGQILDILVSRSLKMRGQAFVIFKEVSSATNAL
RSMQGFPFYDKPMRIQYAKTDSDIIAKMK;

EPN-01-HIV_NC (SEQ ID NO: 262)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQ<u>GGSKGS</u>MQKGNFRNQRKTVKCFNCGKE
GHIAKNCRAPRKKGCWKCGKEGHQMKDCTERQAN;

EPN-01-HIV_NC-FS (SEQ ID NO: 263)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQGS<u>FFREDLAFLQGKARELGGSKGS</u>MQKG
NFRNQRKTVKCFNCGKEGHIAKNCRAPRKKGCWKCGKEGHQMKDCTERQAN;

EPN-01-posT1-HIV_NC (SEQ ID NO: 264)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQ<u>GGSKGS</u>MQKGNFRNQRKTVKCFNCG
KEGHIAKNCRAPRKKGCWKCGKEGHQMKDCTERQAN;

EPN-01-posT1-HIV_NC-FS (SEQ ID NO: 265)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQGS<u>FFREDLAFLQGKARELGGS</u>KGSMQ
KGNFRNQRKTVKCFNCGKEGHIAKNCRAPRKKGCWKCGKEGHQMKDCTERQAN;

EPN-01-1mnb (SEQ ID NO: 266)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQ<u>GGSKGS</u>RPRGTRGKGRRIRR;

EPN-01-1mnb-FS (SEQ ID NO: 267)
(M)GARASGSKSGSGSDSGSKIEELFKKHKIVAVLRANSVEEAKKKALAVFLGGVHLIEITFTV
PDADTVIKELSFLKEMGAIIGAGTVTSVEQCRKAVESGAEFIVSPHLDEEISQFCKEKGVFYMP
GVMTPTELVKAMKLGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)LQSRPEPTAPPEESFRS
GVETTTPPQKQEPIDKELYPLTSLRSLFGNDPSSQGS<u>FFREDLAFLQGKARELGGS</u>KGSRPRGT
RGKGRRIRR;

EPN-01-posT1-1mnb (SEQ ID NO: 268)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQ<u>GGSKGS</u>RPRGTRGKGRRIRR;
and EPN-01-posT1-1mnb-FS (SEQ ID NO: 269)
(M)GARASGSKSGSGSDSGSKMEELFKKHKIVAVLRANSVEEAKKKALAVFLGGVHLIEITFT
VPDADTVIKELSFLKEMGAIIGAGTVTSVEQCRKAVESGAEFIVSPHLDEEISQFCKEKGVFY
MPGVMTPTELVKAMKLGHTILKLFPGEVVGPQFVKAMKGPFPNVKFVPTGGVNLKNVCKW
FKAGVLAVGVGKALVKGTPVEVAKKAKAFVKKIRGCTE(QKLISEEDL)QSRPEPTAPPEESF
RSGVETTTPPQKQEPIDKELYPLTSLRSLFGNDPSSQGS<u>FFREDLAFLQGKARELGGS</u>KGSRPR
GTRGKGRRIRR.

In another embodiment, the multimeric assembly of any embodiment or combination of embodiments further comprises a lipid bilayer enveloping the multimeric assembly, wherein one or more of the M domains of each multimeric assembly, oligomeric structure, and/or protein is bound to the lipid bilayer. As shown in the attached examples, the inventors have shown that such lipid bilayer membrane-enveloped multimeric assemblies can be readily produced by eukaryotic cells expressing the recombinant polypeptides and polypeptide compositions of the invention (see below). This embodiment of the multimeric assemblies of the invention is particularly useful for delivery of a desired cargo to a cell or tissue of interest. As described in the examples below, that inventors have shown that the preparation of enveloped multimeric assemblies requires the presence of M domains, O interfaces, and L domains in the multimeric assemblies. The M domains enable the multimeric assemblies to interact with the host cell membrane. As will be understood by those of skill in the art, it is not required that all M domains in a multimeric assembly actually interact with the lipid bilayer, so long as the plurality of M domains in the multimeric assembly are adequate to drive association with the membrane and/or result in deformation of the lipid bilayer upon multimerization. As such, and as the inventors have shown in the examples below, it is not required that all protein subunits in a multimeric assembly comprise an M domain, so long as the plurality of M domains in the multimeric assembly are adequate to drive association with the membrane and/or result in deformation of the lipid bilayer upon multimerization. Thus, in one embodiment, the multimeric assembly packages a cargo not by interacting directly with the cargo molecule, but rather by driving the packaging of a small volume of the eukaryotic host cell cytoplasm containing the cargo molecule inside a lipid bilayer envelope that contains one or more copies of the multimeric assembly. In this way, cargo molecules including but not limited to proteins, nucleic acids, lipids, small molecules, or any combination thereof can be packaged in combination with the multimeric assemblies. The cargo molecules packaged in this way may be endogenously produced molecules, or may be produced by overexpression of one or more recombinant genes in the host cell. Many enveloped viruses are known to package host cell molecules inside or within their membranes envelopes in this manner (e.g., Gentili M, et al. (2015) Transmission of innate immune signaling by packaging of cGAMP in viral particles. Science 349:1232-6; Bridgeman A, et al. (2015) Viruses transfer the antiviral second messenger cGAMP between cells. Science 349:1228-32; Apolonia L et al. (2015), PLoS Pathogens 11:e1004609; Rosa A et al. (2015), 526:212-7; Usami Y, et al. (2015), Nature 526:218-23). In one non-limiting embodiment, the small molecule immune activator 2',3'-cyclic GMP-AMP (cGAMP) (Wu et al, Science 15 Feb. 2013: 826-830) may be packaged as a cargo molecule, as described in the examples that follow. In a further non-limiting embodiment, the cGAMP may be produced by expression of recombinant cyclic GMP-AMP synthase (cGAS) (Sun et al, Science 15 Feb. 2013: 786-791) in the host cell using an expression plasmid.

The O interfaces are required to drive self-assembly or multimerization of the multimeric assemblies. This process both defines the structure of the multimeric assemblies as described above and enhances membrane binding and/or drives deformation of the lipid bilayer membrane to form bud-like structures that remain tethered to the host cell by a membrane neck. The L domains are required to recruit the host cell ESCRT machinery to the site of budding in order to effect release of the budding enveloped multimeric assembly from the host cell by scission of the membrane neck. The L domains may recruit the ESCRT machinery by interacting directly or indirectly with protein subunits of the ESCRT complex. In certain embodiments, it is preferred that the L domains of the multimeric assemblies interact with host proteins known to recruit the ESCRT machinery to sites of virus budding in cells. Such proteins include but are not limited to Tsg101, ALIX, and members of the Nedd4 family of ubiquitin ligases (McDonald B, Martin-Serrano J (2009) No strings attached: the ESCRT machinery in viral budding and cytokinesis. J. Cell Sci. 122:2167-77).

In another embodiment, the enveloped multimeric assembly further comprises one or more transmembrane protein or membrane-anchored protein embedded in the lipid bilayer. This embodiment may be used to add additional functionality of any desired type to the multimeric assemblies. In this embodiment, the transmembrane protein or membrane-anchored protein may be one not present as part of the oligomeric substructure or protein subunit, in that they are added to the assembly during or after envelopment of the multimeric assembly by the lipid bilayer and do not necessarily interact with the protein subunits of the multimeric assembly either covalently or non-covalently. Any suitable transmembrane protein or membrane-anchored protein can be added that provides any desired additional functionality to the assembly, in terms of cell targeting, the display of transmembrane or membrane-anchored antigen for vaccines, or other desired use. In one non-limiting example, the transmembrane protein or membrane-anchored protein embedded in the lipid bilayer comprises a viral envelope protein that enables the enveloped multimeric assembly to enter cells via receptor-mediated endocytosis and/or mediates fusion of the lipid bilayer of the enveloped multimeric assembly with cellular membranes. In the study of enveloped viruses, the practice of incorporating a foreign viral envelope protein in the membrane of an enveloped virus is referred to as "pseudotyping." By co-expressing the foreign viral envelope protein with the viral or virus-like particle proteins, the foreign viral envelope protein becomes embedded in the membrane bilayer of the cells, and is therefore incorporated into the membrane envelope of the budding virions or virus-like particles. As the inventors have shown below, viral envelope proteins (in one embodiment, the G protein of Vesicular Stomatitis Virus) can be incorporated in the membrane envelopes of the enveloped multimeric assemblies of the invention in a similar manner. In various non-limiting embodiments, additional classes of membrane proteins can be incorporated into the membrane envelopes of the multimeric assemblies of the invention. In various non-limiting embodiments, the transmembrane or membrane-anchored protein is selected from the group consisting of the envelope proteins of enveloped viruses, membrane protein transporters, membrane protein channels, B cell receptors, T cell receptors, transmembrane antigens of human pathogens, growth factors receptors, G-protein coupled receptors (GPCRs), complement regulatory proteins including but not limited to CD55 and CD59, or processed versions thereof.

In specific embodiments, the one or more transmembrane protein or membrane-anchored protein embedded in the lipid bilayer comprise one or more of the following polypeptides, or a processed version thereof. As will be understood by those of skill in the art, the polypeptide sequences provided are full-length protein precursors, which are cleaved or otherwise processed (i.e., "processed") to generate the final envelope protein embedded in the lipid bilayer.

VSV-G
(SEQ ID NO: 307)
MKCLLYLAFLFIGVNCKFTIVFPHNQKGNWKNVPSNYHYCPSSSDLNWHNDLIGTALQVKM

PKSHKAIQADGWMCHASKWVTTCDFRWYGPKYITHSIRSFTPSVEQCKESIEQTKQGTWLNP

GFPPQSCGYATVTDAEAVIVQVTPHHVLVDEYTGEWVDSQFINGKCSNYICPTVHNSTTWHS

DYKVKGLCDSNLISMDITFFSEDGELSSLGKEGTGFRSNYFAYETGGKACKMQYCKHWGVR

LPSGVWFEMADKDLFAAARFPECPEGSSISAPSQTSVDVSLIQDVERILDYSLCQETWSKIRAG

LPISPVDLSYLAPKNPGTGPAFTIINGTLKYFETRYIRVDIAAPILSRMVGMISGTTTERELWDD

WAPYEDVEIGPNGVLRTSSGYKFPLYMIGHGMLDSDLHLSSKAQVFEHPHIQDAASQLPDDE

SLFFGDTGLSKNPIELVEGWFSSWKSSIASFFFIIGLIIGLFLVLRVGIHLCIKLKHTKKRQIYTDI

EMNRLGK;

Ecotropic envelope protein from Moloney Murine Leukemia Virus or "Eco"
(SEQ ID NO: 308)
MARSILSKPLKNKVNPRGPLIPLILLMLRGVSTASPGSSPHQVYNITWEVTNGDRETNTWATS

GNHPLWTWWPDLTPDLCMLAHHGPSWGLEYQSPFSSPPGPPCCSGGSSPGCSRDCEEPLTS

LTPRCNTAWNRLKLDQTTHESNEGFYVCPGPFIRPRESKSCGGPDSFYCAYWGCETTGRAYW

KPSSSWDFITVNNNLTSDQAVQVCKDNKWCNPLVIRFTDAGRRVTSWTTGHYWGLRLYVS

GQDPGLIFGIRLRYQNLGPRVPIGPNPVLADQQPLSKPKPVKSPSVTKPPSGTPLSPTQLPPAG

TENRLLNLVDGAYQALNLTSPDKIQECWLCINAGPPYYEGVAVLGTYSNHISAPANCSVAS

QHKLTLSEVIGQGLCIGAVPKTHQALCNTTQTSSRGSYYLVAPTGTMWACSTGLTPCISTTIL

NLTTDYCVLVELWPRVTYHSPSYVYGLFERSNRIIKREPVSLTLALLLGGLTMGGIAAGIGTG

TTALMATQQFQQLQAAVQDDLREVEKSISNLEKSLTSLSEVVLQNRRGLDLLFLKEGGLCAA

LKEECCFYADHTGLVRDSMAKLRERLNQRQKLFESTQGWFEGLFNRSPWFTTLISTIMGPLIV

LLMILLFGPCILNRLVQFVKDRISVVQALVLTQQYHQLKPIEYEP;

Amphotropic Murine Leukemia Virus Envelope 4070A
(SEQ ID NO: 309)
MARSTLSKPPQDKINPWKPLIVMGVLLGVGMAESPHQVFNVTWRVTNLMTGRTANATSLL

GTVQDAFPKLYFDLCDLVGEEWDPSDQEPYVGYGCKYPAGRQRTRTFDFYVCPGHTVKSG

CGGPGEGYCGKWGCETTGQAYWKPTSSWDLISLKRGNTPWDTGCSKVACGPCYDLSKVSN

SFQGATRGGRCNPLVLEFTDAGKKANWDGPKSWGLRLYRTGTDPITMFSLTRQVLNVGPRV

PIGPNPVLPDQRLPSSPIEIVPAPQPPSPLNTSYPPSTTSTPSTSPTSPSVPQPPPGTG

DRLLALVKGAYQALNLTNPDKTQECWLCLVSGPPYYEGVAVVGTYTNHSTAPANCTATSQ

HKLTLSEVTGQGLCMGAVPKTHQALCNTTQSAGSGSYYLAAPAGTMWACSTGLTPCLSTT

VLNLTTDYCVLVELWPRVIYHSPDYMYGQLEQRTKYKREPVSLTLALLLGGLTMGGIAAG

IGTGTTALIKTQQFEQLHAAIQTDLNEVEKSITNLEKSLTSLSEVVLQNRRGLDLLFLKE

GGLCAALKEECCFYADHTGLVRDSMAKLRERLNQRQKLFETGQGWFEGLFNRSPWFTTLI

STIMGPLIVLLLILLFGPCILNRLVQFVKDRISVVQALVLTQQYHQLKPIEYEP;

Sindbis virus E3-E2-6K-E1 envelope polyprotein
(SEQ ID NO: 310)
SAAPLVTAMCLLGNVSFPCDRPPTCYTREPSRALDILEENVNHEAYDTLLNAILRCGSSG

RSKRSVIDDFTLTSPYLGTCSYCHHTVPCFSPVKIEQVWDEADDNTIRIQTSAQFGYDQSGAA

SANKYRYMSLKQDHTVKEGTMDDIKISTSGPCRRLSYKGYFLLAKCPPGDSVTVSIVSSNSAT

SCTLARKIKPKFVGREKYDLPPVHGKKIPCTVYDRLKETTAGYITMHRPRPHAYTSYL

EES SGKVYAKPPSGKNITYECKCGDYKTGTVSTRTEITGCTAIKQCVAYKSDQTKWVFNS

PDLIRHDDHTAQGKLHLPFKLIPSTCMVPVAHAPNVIHGFKHISLQLDTDHLTLLTTRRL

GANPEPTTEWIVGKTVRNFTVDRDGLEYIWGNHEPVRVYAQESAPGDPHGWPHEIVQHYY

HRHPVYTILAVASATVAMMIGVTVAVLCACKARRECLTPYALAPNAVIPTSLALLCCVRS

ANAETFTETMSYLWSNSQPFFWVQLCIPLAAFIVLMRCCSCCLPFLVVAGAYLAKVDAYEHA

TTVPNVPQIPYKALVERAGYAPLNLEITVMSSEVLPSTNQEYITCKFTTVVPSPKIKCCGSLEC

QPAAHADYTCKVFGGVYPFMWGGAQCFCDSENSQMSEAYVELSADCASDHAQAIKVHTAA

MKVGLRIVYGNTTSFLDVYVNGVTPGTSKDLKVIAGPISASFTPFDHKVVIH

RGLVYNYDFPEYGAMKPGAFGDIQATSLTSKDLIASTDIRLLKPSAKNVHVPYTQASSGF

EMWKNNSGRPLQETAPFGCKIAVNPLRAVDCSYGNIPISIDIPNAAFIRTSDAPLVSTVK

CEVSECTYSADFGGMATLQYVSDREGQCPVHSHSSTATLQESTVHVLEKGAVTVHFSTAS

PQANFIVSLCGKKTTCNAECKPPADHIVSTPHKNDQEFQAAISKTSWSWLFALFGGASSL

LIIGLMIFACSMMLTSTRR;

Ebola GP (Zaire Mayinga strain)
(SEQ ID NO: 311)
MGVTGILQLPRDRFKRTSFFLWVIILFQRTFSIPLGVIHNSTLQVSDVDKLVCRDKLSST

NQLRSVGLNLEGNGVATDVPSATKRWGFRSGVPPKVVNYEAGEWAENCYNLEIKKPDGSE

CLPAAPDGIRGFPRCRYVHKVSGTGPCAGDFAFHKEGAFFLYDRLASTVIYRGTTFAEGV

VAFLILPQAKKDFFSSHPLREPVNATEDPSSGYYSTTIRYQATGFGTNETEYLFEVDNLT

YVQLESRFTPQFLLQLNETIYTSGKRSNTTGKLIWKVNPEIDTTIGEWAFWETKKNLTRK

IRSEELSFTVVSNGAKNISGQSPARTSSDPGTNTTTEDHKIMASENSSAMVQVHSQGREA

AVSHLTTLATISTSPQSLTTKPGPDNSTHNTPVYKLDISEATQVEQHHRRTDNDSTASDT

PSATTAAGPPKAENTNTSKSTDFLDPATTTSPQNHSETAGNNNTHHQDTGEESASSGKLG

LITNTIAGVAGLITGGRRTRREAIVNAQPKCNPNLHYWTTQDEGAAIGLAWIPYFGPAAE

GIYIEGLMHNQDGLICGLRQLANETTQALQLFLRATTELRTFSILNRKAIDFLLQRWGGT

CHILGPDCCIEPHDWTKNITDKIDQIIHDFVDKTLPDQGDNDNWWTGWRQWIPAGIGVTG

VIIAVIALFCICKFVF;

Human Immunodeficiency Virus envelope glycoprotein precursor gp160
(SEQ ID NO: 312)
MRVKEKYQHLWRWGWKWGIMLLGILMICSATENLWVTVYYGVPVWKEATTTLFCASDAK

AYDTEVHNVCATHACVPTDPNPQEVILVNVTENFDMWKNDMVEQMHEDIISLWDQSLKPC

VKLTPLCVNLKCTDLKNDTNTNSSNGRMIMEKGEIKNCSFNISTSIRNKVQKEYAFFYKLD

IRPIDNTTYRLISCNTSVITQACPKVSFEPIPIHYCAPAGFAILKCNDKTFNGTGPCTNV

STVQCTHGIRPVVSTQLLLNGSLAEEEGVIRSANFTDNAKTIIVQLNTSVEINCTRPNNN

TRKSIRIQRGPGRAFVTIGKIGNMRQAHCNISRAKWMSTLKQIASKLREQFGNNKTVIFK

QSSGGDPEIVTHSFNCGGEFFYCNSTQLFNSTWFNSTWSTEGSNNTEGSDTITLPCRIKQ

FINMWQEVGKAMYAPPISGQIRCSSNITGLLLTRDGGKNTNESEVFRPGGGDMRDNWRSE

LYKYKVVKIETLGVAPTKAKRRVVQREKRAVGIGALFLGFLGAAGSTMGAASMTLTVQAR

QLLSGIVQQQNNLLRAIEAQQHLLQLTVWGIKQLQARILAVERYLKDQQLLGIWGCSGKL

ICTTAVPWNASWSNKSLEQFWNNMTWMEWDREINNYTSLIHSLIDESQNQQEKNEQELLE

LDKWASLWNWFNITNWLWYIKIFIMIVGGLVGLRIVFAVLSIVNRVRQGYSPLSFQTHLP

NRGGPDRPEGIEEEGGERDRDRSVRLVNGSLALIWDDLRSLCLFSYHRLRDLLLIVTRIV

ELLGRRGWEALKYWWNLLQYWSQELKNSAVSLLNATAIAVAEGTDRVIEVVQGAYRAIRH

IPRRIRQGLERIL;

-continued

Respiratory Syncytial Virus F protein precursor
(SEQ ID NO: 313)
MELLILKANAITTILTAVTFCFASGQNITEEFYQSTCSAVSKGYLSALRTGWYTSVITIE

LSNIKENKCNGTDAKVKLIKQELDKYKNAVTELQLLMQSTPPTNNRARRELPRFMNYTLN

NAKKTNVTLSKKRKRRFLGFLLGVGSAIASGVAVSKVLHLEGEVNKIKSALLSTNKAVVS

LSNGVSVLTSKVLDLKNYIDKQLLPIVNKQSCSISNIETVIEFQQKNNRLLEITREFSVN

AGVTTPVSTYMLTNSELLSLINDMPITNDQKKLMSNNVQIVRQQSYSIMSIIKEEVLAYV

VQLPLYGVIDTPCWKLHTSPLCTTNTKEGSNICLTRTDRGWYCDNAGSVSFFPQAETCKV

QSNRVFCDTMNSLTLPSEINLCNVDIFNPKYDCKIMTSKTDVSSSVITSLGAIVSCYGKT

KCTASNKNRGIIKTFSNGCDYVSNKGMDTVSVGNTLYYVNKQEGKSLYVKGEPIINFYDP

LVFPSDEFDASISQVNEKINQSLAFIRKSDELLHNVNAGKSTTNIMITTIIIVIIVILLS

LIAVGLLLYCKARSTPVTLSKDQLSGINNIAFSN;

SARS Coronavirus spike protein
(SEQ ID NO: 314)
MFIFLLFLTLTSGSDLDRCTTFDDVQAPNYTQHTSSMRGVYYPDEIFRSDTLYLTQDLFL

PFYSNVTGFHTINHTFGNPVIPFKDGIYFAATEKSNVVRGWVFGSTMNNKSQSVIIINNS

TNVVIRACNFELCDNPFFAVSKPMGTQTHTMIFDNAFNCTFEYISDAFSLDVSEKSGNFK

HLREFVFKNKDGFLYVYKGYQPIDVVRDLPSGFNTLKPIFKLPLGINITNFRAILTAFSP

AQDIWGTSAAAYFVGYLKPTTFMLKYDENGTITDAVDCSQNPLAELKCSVKSFEIDKGIY

QTSNFRVVPSGDVVRFPNITNLCPFGEVFNATKFPSVYAWERKKISNCVADYSVLYNSTF

FSTFKCYGVSATKLNDLCFSNVYADSFVVKGDDVRQIAPGQTGVIADYNYKLPDDFMGCV

LAWNTRNIDATSTGNYNYKYRYLRHGKLRPFERDISNVPFSPDGKPCTPPALNCYWPLND

YGFYTTTGIGYQPYRVVVLSFELLNAPATVCGPKLSTDLIKNQCVNFNFNGLTGTGVLTP

SSKRFQPFQQFGRDVSDFTDSVRDPKTSEILDISPCSFGGVSVITPGTNASSEVAVLYQD

VNCTDVSTAIHADQLTPAWRIYSTGNNVFQTQAGCLIGAEHVDTSYECDIPIGAGICASY

HTVSLLRSTSQKSIVAYTMSLGADSSIAYSNNTIAIPTNFSISITTEVMPVSMAKTSVDC

NMYICGDSTECANLLLQYGSFCTQLNRALSGIAAEQDRNTREVFAQVKQMYKTPTLKYFG

GFNFSQILPDPLKPTKRSFIEDLLFNKVTLADAGFMKQYGECLGDINARDLICAQKFNGL

TVLPPLLTDDMIAAYTAALVSGTATAGWTFGAGAALQIPFAMQMAYRFNGIGVTQNVLYE

NQKQIANQFNKAISQIQESLTTTSTALGKLQDVVNQNAQALNTLVKQLSSNFGAISSVLN

DILSRLDKVEAEVQIDRLITGRLQSLQTYVTQQLIRAAEIRASANLAATKMSECVLGQSK

RVDFCGKGYHLMSFPQAAPHGVVFLHVTYVPSQERNFTTAPAICHEGKAYFPREGVFVFN

GTSWFITQRNFFSPQIITTDNTFVSGNCDVVIGIINNTVYDPLQPELDSFKEELDKYFKN

HTSPDVDLGDISGINASVVNIQKEIDRLNEVAKNLNESLIDLQELGKYEQYIKWPWYVWL

GFIAGLIAIVMVTILLCCMTSCCSCLKGACSCGSCCKFDEDDSEPVLKGVKLHYT;

Influenza hemagglutinin
(SEQ ID NO: 315)
MKTIIALSYIFCLALGQDLPGNDNSTATLCLGHHAVPNGTLVKTITDDQIEVTNATELVQ

SSSTGKICNNPHRILDGIDCTLIDALLGDPHCDVFQNETWDLFVERSKAFSNCYPYDVPD

YASLRSLVASSGTLEFITEGFTWTGVTQNGGSNACKRGPGSGFFSRLNWLTKSGSTYPVL

NVTMPNNDNFDKLYIWGIFIHPSTNQEQTSLYVQASGRVTVSTRRSQQTIIPNIGSRPWVR

GLSSRISIYWTIVKPGDVLVINSNGNLIAPRGYFKMRTGKSSIMRSDAPIDTCISECITP

NGSIPNDKPFQNVNKITYGACPKYVKQNTLKLATGMRNVPEKQTRGLFGAIAGFIENGWE

GMIDGWYGFRHQNSEGTGQAADLKSTQAAIDQINGKLNRVIEKTNEKFHQIEKEFSEVEG

-continued

```
RIQDLEKYVEDTKIDLWSYNAELLVALENQHTIDLTDSEMNKLFEKTRRQLRENAEEMGN

GCFKIYHKCDNACIESIRNGTYDHDVYRDEALNNRFQIKGVELKSGYKDWILWISFAISC

FLLCVVLLGFIMWACQRGNIRCNICI.
```

In another aspect, the invention provides recombinant polypeptides comprising
 (a) a polypeptide-polypeptide interface ("O interface"); and
 (b) a polypeptide domain that is capable of interacting with one or more proteins in the eukaryotic ESCRT complex ("L domain");
wherein the L domain, and the O interface are not each present in a single naturally occurring protein.

In another embodiment, the recombinant polypeptides comprising
 (a) a polypeptide domain that is capable of interacting with a lipid bilayer ("M domain");
 (b) a polypeptide-polypeptide interface ("O interface"); and
 (c) a polypeptide domain that is capable of interacting with one or more proteins in the eukaryotic ESCRT complex ("L domain");
wherein the M domain, the L domain, and the O interface are not each present in a single naturally occurring protein.

In a further aspect, the invention provides recombinant polypeptide compositions, comprising a first polypeptide and a second polypeptide, wherein the first polypeptide and the second polypeptide each comprise an O interface, wherein the O interface on the first polypeptide is capable of interacting with the O interface on the second polypeptide, and wherein at least one of the first polypeptide or the second polypeptide comprises:
 (a) an optional domain capable of interacting with a lipid bilayer ("M domain"); and
 (b) a domain capable of interacting with one or more proteins in the eukaryotic ESCRT complex ("L domain");
wherein the M domain (if present), the L domain, and the O interface are not each present in a single naturally occurring protein.

The recombinant polypeptides and polypeptide compositions of the invention can be used, for example, to generate the multimeric assemblies of the invention. All definitions and examples described herein for the multimeric assemblies of the invention are applicable to the polypeptides of the invention. Thus, any embodiment of the M domain, L domain, 0 interface, and combinations thereof that are described herein can be used in the recombinant polypeptides and polypeptide complexes of the invention. Thus, in various embodiments, the M domain is capable of non-covalently interacting with a lipid bilayer; the L domain is capable of non-covalently interacting with one or more proteins in the ESCRT complex; the M domain comprises a polypeptide having an acylation motif (including but not limited to N-terminal myristoylation motifs, palmitoylation motifs, farnesylation motifs, and geranylgeranylation motifs), a polar headgroup-binding domains (including but not limited to those disclosed herein, and in: Stahelin R V (2009) Lipid binding domains: more than simple lipid effectors. J. Lipid Res. 50:S299-304), or transmembrane protein domains; the M domain is selected from the group consisting of the M domains disclosed herein; the O interface comprises a non-natural polypeptide; the O interface-containing polypeptide comprises or consists of a polypeptide selected from the group consisting of the O interface-containing polypeptides disclosed herein and in the attached appendices; the L domain comprises a linear amino acid sequence motif selected from the group consisting of P(T/S)AP (SEQ ID NO: 152), YP(X)$_n$L (SEQ ID NO: 301), PPxY (SEQ ID NO: 154), and overlapping combinations thereof (including but not limited to P(T/S)APPxY (SEQ ID NO: 155), P(T/S)AP YP(X)$_n$L (SEQ ID NO: 156), PPxYP (T/S)AP (SEQ ID NO: 157), PPxYYP(X)$_n$L (SEQ ID NO: 158), YP(X)$_n$LPPxY (SEQ ID NO: 159), and YP(X)$_n$LP-PxY) (SEQ ID NO: 160); the L domain is selected from the group consisting of the late domains disclosed herein.

In further embodiments, the recombinant polypeptide or polypeptide composition further comprises a packaging moiety, as described herein. In various embodiments, the packaging moiety comprises a cysteine residue, a non-canonical amino acid residue, any polypeptide that interacts with a cargo covalently or non-covalently to recruit the cargo to the multimeric assembly, or a polypeptide sequence selected from the group consisting of the packaging moieties disclosed herein.

In another aspect, the invention provides polypeptides comprising an amino acid " " sequence at least 75% identical over its full length to

```
SEQ ID: 20 (I3-01)
                                       (SEQ ID NO: 20)
(M)KMEELFKKHKIVAVLRANSVEEAKKKALAVFLGGVHLIEITFTVPDAD

TVIKELSFLKEMGAIIGAGTVTSVEQCRKAVESGAEFIVSPHLDEEISQFC

KEKGVFYMPGVMTPTELVKAMKLGHTILKLFPGEVVGPQFVKAMKGPFPNV

KFVPTGGVNLDNVCEWFKAGVLAVGVGSALVKGTPVEVAEKAKAFVEKIRG

CTE,
or

SEQ ID 304: (I3-01(M3I)
(M)KIEELFKKHKIVAVLRANSVEEAKKKALAVFLGGVHLIEITFTVPDAD

TVIKELSFLKEMGAIIGAGTVTSVEQCRKAVESGAEFIVSPHLDEEISQFC

KEKGVFYMPGVNITPTELVKANIKLGHTILKLFPGEVVGPQFVKANIKGPF

PNVKFVPTGGVNLDNVCEWFKAGVLAVGVGSALVKGTPVEVAEKAKAFVEK

IRGCTE;
``` wherein the polypeptide includes at least 1, 2, 3, 4, 5, or more amino acid substitutions compared to SEQ NO: 21 (1wa3-wt)

```
(1wa3-wt)
                                       SEQ ID: 21
MKMEELFKKHKIVAVLRANSVEEAKEKALAVFEGGVHLIEITFTVPDADTV

IKELSFLKEKGAIIGAGTVTSVEQCRKAVESGAEFIVSPHLDEEISQFCKE

KGVFYMPGVMTPTELVKAMKLGHTILKLFPGEVVGPQFVKAMKGPFPNVKF

VPTGGVNLDNVCEWFKAGVLAVGVGSALVKGTPDEVREKAKAFVEKIRGCT

E
```

In various further embodiments, the polypeptide is at least 80%, 85%, 90%, 95%, 96%, 97%, 98%, 99%, or 100% identity to the amino acid sequence of SEQ ID NO: 20 or 304.

As used throughout the present application, the term "protein" or "polypeptide" are used in their broadest sense to refer to a sequence of subunit amino acids. The proteins or polypeptides of the invention may comprise L-amino acids, D-amino acids (which are resistant to L-amino acid-specific proteases in vivo), or a combination of D- and L-amino acids. The proteins or polypeptides described herein may be chemically synthesized or recombinantly expressed.

In another aspect, the present invention provides recombinant nucleic acids encoding the recombinant polypeptides or polypeptide compositions of the present invention. The isolated nucleic acid sequence may comprise RNA or DNA. Such recombinant nucleic acid sequences may comprise additional sequences useful for promoting expression and/or purification of the encoded protein, including but not limited to polyA sequences, modified Kozak sequences, and sequences encoding epitope tags, export signals, and secretory signals, nuclear localization signals, and plasma membrane localization signals. It will be apparent to those of skill in the art, based on the teachings herein, what nucleic acid sequences will encode the recombinant polypeptides or polypeptide compositions of the invention.

In a further aspect, the present invention provides recombinant expression vectors comprising the recombinant nucleic acid of any embodiment or combination of embodiments of the invention operatively linked to a suitable control sequence. "Recombinant expression vector" includes vectors that operatively link a nucleic acid coding region or gene to any control sequences capable of effecting expression of the gene product. "Control sequences" operably linked to the nucleic acid sequences of the invention are nucleic acid sequences capable of effecting the expression of the nucleic acid molecules. The control sequences need not be contiguous with the nucleic acid sequences, so long as they function to direct the expression thereof. Thus, for example, intervening untranslated yet transcribed sequences can be present between a promoter sequence and the nucleic acid sequences and the promoter sequence can still be considered "operably linked" to the coding sequence. Other such control sequences include, but are not limited to, polyadenylation signals, termination signals, and ribosome binding sites. Such expression vectors can be of any type known in the art, including but not limited to plasmid and viral-based expression vectors. The control sequence used to drive expression of the disclosed nucleic acid sequences in a mammalian system may be constitutive (driven by any of a variety of promoters, including but not limited to, CMV, SV40, RSV, actin, EF) or inducible (driven by any of a number of inducible promoters including, but not limited to, tetracycline, ecdysone, steroid-responsive). The construction of expression vectors for use in transfecting prokaryotic cells is also well known in the art, and thus can be accomplished via standard techniques. (See, for example, Sambrook, Fritsch, and Maniatis, in: Molecular Cloning, A Laboratory Manual, Cold Spring Harbor Laboratory Press, 1989; Gene Transfer and Expression Protocols, pp. 109-128, ed. E. J. Murray, The Humana Press Inc., Clifton, N.J.), and the Ambion 1998 Catalog (Ambion, Austin, Tex.). The expression vector must be replicable in the host organisms either as an episome or by integration into host chromosomal DNA. In non-limiting embodiments, the expression vector may comprise a plasmid or a viral vector.

In another aspect, the present invention provides recombinant host cells that comprise the recombinant expression vectors disclosed herein, wherein the host cells can be either prokaryotic or eukaryotic, such as mammalian cells. The cells can be transiently or stably transfected. Such transfection of expression vectors into prokaryotic and eukaryotic cells can be accomplished via any technique known in the art, including but not limited to standard bacterial transformations, calcium phosphate co-precipitation, electroporation, or liposome mediated-, DEAE dextran mediated-, polycationic mediated-, or viral mediated transfection or transduction. (See, for example, *Molecular Cloning: A Laboratory Manual* (Sambrook, et al., 1989, Cold Spring Harbor Laboratory Press; *Culture of Animal Cells: A Manual of Basic Technique*, $2^{nd}$ Ed. (R. I. Freshney. 1987. Liss, Inc. New York, N.Y.).

As will be understood by those of skill in the art, some components of the lipid-enveloped multimeric assemblies may be encoded on different recombinant expression vectors that are present in the recombinant host cells. In one embodiment, the one or more transmembrane proteins or membrane-anchored proteins may be encoded on a second recombinant expression vector in the recombinant host cell, operatively linked to a suitable control sequence. In various embodiments, the second recombinant expression vector encodes a protein selected from the group consisting of SEQ ID NOS: 307-315.

In another embodiment, a the recombinant host cell may comprise a third recombinant expression vector comprising a recombinant nucleic acid encoding cyclic GMP-AMP synthase (cGAS) protein (SEQ ID NO:328) operatively linked to a promoter. This embodiment is useful when the desired cargo is 2',3'-cyclic GMP-AMP (cGAMP), as described in detail in the examples that follow. In another embodiment, the third recombinant expression vector comprises a recombinant nucleic acid encoding a cargo operatively linked to a promoter. Such cargo can be any suitable cargo as disclosed herein, including but not limited to a polypeptide or polynucleotide selected from the group consisting of SEQ ID NOS:202-219.

A method of producing a polypeptide according to the invention is an additional part of the invention. The method comprises the steps of (a) culturing a recombinant host according to this aspect of the invention under conditions conducive to the expression of the polypeptide, and (b) optionally, recovering the expressed polypeptide.

In a further aspect, the invention provides methods for producing a multimeric assembly comprising a lipid bilayer enveloping the multimeric assembly, comprising culturing eukaryotic recombinant host cells of the invention (such as mammalian cells) under conditions suitable to promote expression of the encoded recombinant polypeptide or polypeptide composition, wherein expression of the encoded recombinant polypeptide or polypeptide composition in the eukaryotic host cell results in (a) production of the multimeric assembly, and (b) interaction of one or more of the M domains of the multimeric assembly with the lipid bilayer membrane of the eukaryotic host cell, and wherein attachment of the one or more M domains of the multimeric assembly to the lipid bilayer membrane of the eukaryotic host cell results in the multimeric assembly being enveloped by eukaryotic host-derived lipid bilayer membrane, followed by recruitment of the ESCRT machinery to the site of budding by the L domains of the multimeric assembly, which releases the enveloped multimeric assembly from the eukaryotic host cell by catalyzing membrane scission.

Any suitable eukaryotic host cell can be used, including but not limited to mammalian cells. Exemplary such host cells include Chinese hamster ovary (CHO) cells and human primary cells or established human cell lines such as HEK293 cells.

In this embodiment, the M domain chosen for use may be one that binds to the membrane of the eukaryotic host cell to be used for expression, and the L domain chosen for use may be one that binds to interacts directly or indirectly with protein subunits of the host cell ESCRT complex, or interacts with proteins of the host cell known to recruit the ESCRT complex of the host cell to sites of budding.

EXAMPLES

Computational Design of I3-01, a Self-Assembling Protein Icosahedron

The I3-01 polypeptide sequence (SEQ ID 20) was designed using the method of King et al. (Neil P King, William Sheffler, Michael R Sawaya, Breanna S Vollmar, John P Sumida, Ingemar André, Tamir Gonen, Todd O Yeates, David Baker (2012) Computational design of self-assembling protein nanomaterials with atomic level accuracy. Science 336:1171-1174; Neil P King, Jacob B Bale, William Sheffler, Dan E McNamara, Shane Gonen, Tamir Gonen, Todd O Yeates, David Baker (2014) Accurate design of co-assembling multi-component protein nanomaterials. Nature 510:103-108.; U.S. Pat. No. 8,969,521; WO2014/124301). The structure of the trimeric 2-keto-3-deoxy-6-phosphogluconate (KDPG) aldolase from *Thermotoga maritima* (SEQ ID 21; PDB entry 1wa3) was used as the starting point for design in combination with a symmetry definition file suitable for modeling a 60-subunit icosahedral assembly constructed from trimeric building blocks. The designed polypeptide sequence was predicted to spontaneously assemble to a 60-subunit multimeric assembly with icosahedral symmetry when expressed recombinantly. The assembly process was predicted to be driven by the low-energy, inter-trimer protein-protein interface designed computationally (O interface), which comprises five mutations from the natural sequence (1wa3-wt; SEQ ID 21) in addition to several amino acids that remained unchanged from the natural sequence.

Recombinant Expression and Purification of I3-01

A synthetic gene encoding the designed protein I3-01 was constructed and cloned into a bacterial expression vector. *E. coli* cells expressing I3-01 were lysed, and the protein was purified by ammonium sulfate precipitation, heating, and size exclusion chromatography. The *E. coli* cells were resuspended in 25 mM Tris, 150 mM NaCl, pH 8.0 supplemented with 1 mM PMSF, 1 mg/mL DNase, and 1 mg/mL lysozyme and lysed by sonication. The lysates were clarified by centrifugation (20,000×g for 25 minutes at 4° C.) and protein was precipitated by the addition of ammonium sulfate to 60% saturation. The pellet was collected by centrifugation (20,000×g for 15 minutes at 25° C.) and resuspended in 25 mM Tris, 150 mM NaCl, pH 8.0. The solution was heated at 80° C. for 10 minutes, and insoluble material was pelleted by centrifugation (20,000×g for 15 minutes at 4° C.). The supernatant was concentrated using a centrifugal filtration device prior to size exclusion chromatography on an AKTA Pure system equipped with a Superose 6 10/300 column (GE Healthcare). Fractions containing pure protein in the assembled (icosahedral) state were collected and concentrated using a centrifugal filtration device.

Characterization of the Oligomerization State of I3-01

Figure 2:
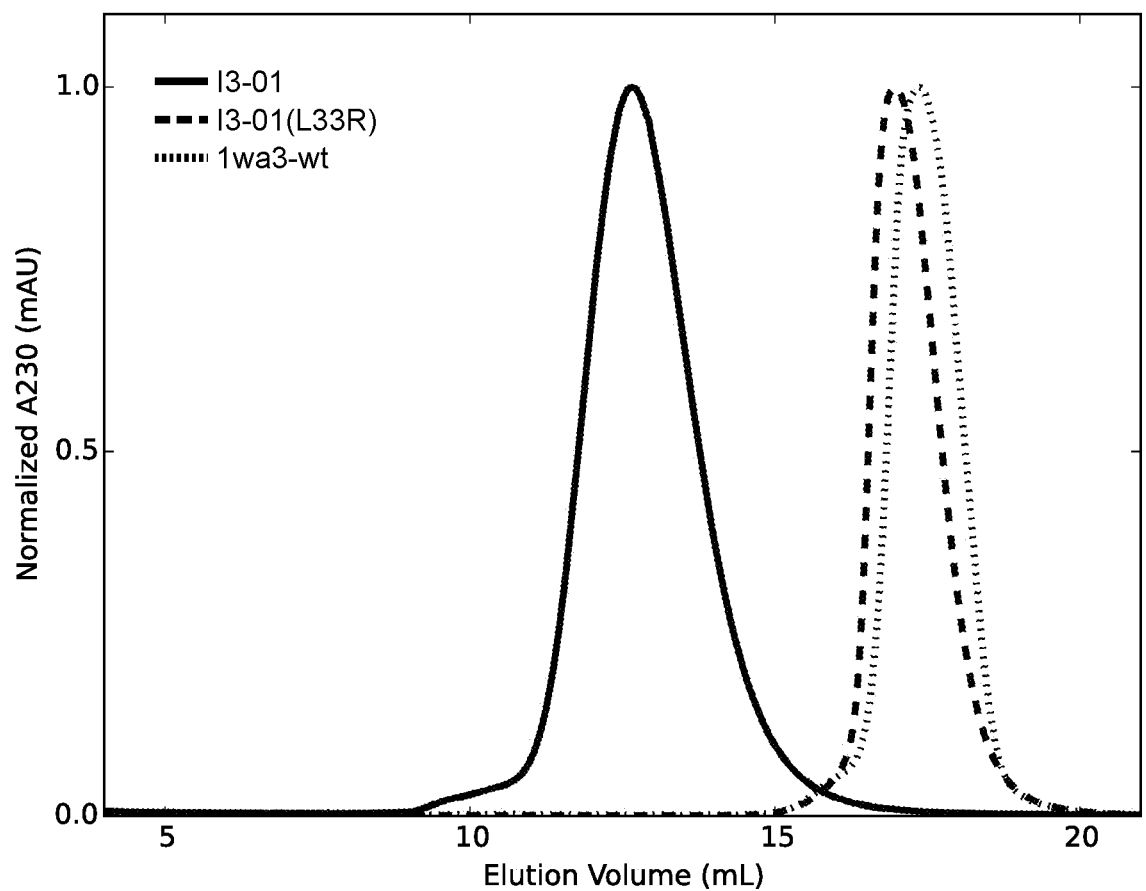
FIG. 2. Size-exclusion chromatography of I3-01, I3-01 (L33R), and 1wa3-wt. Chromatograms of the three proteins obtained using a Superose 6 10/300 GL column (GE Healthcare) are overlaid; the absorbance signal (y-axis) has been normalized so that each peak is of equal height. I3-01 eluted earlier than I3-01(L33R) and 1wa3-wt, indicating assembly to a higher oligomerization state. The elution volume of I3-01 corresponded to that expected for the designed 60-subunit assembly.
Figure 3:
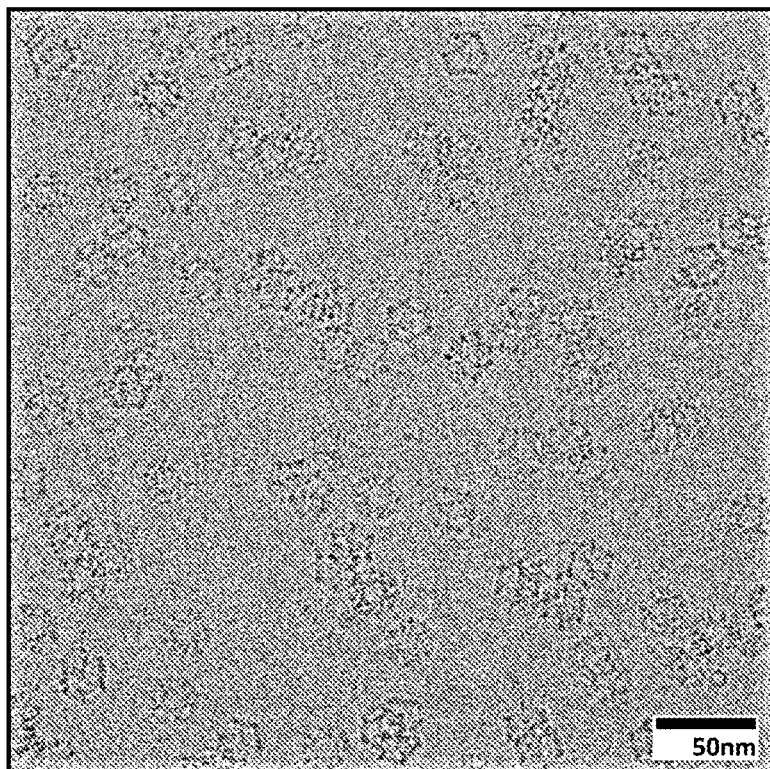
FIG. 3. Cryo-electron micrograph of I3-01 multimeric assemblies. Purified I3-01 was visualized by cryo-electron microscopy. A field of monodisperse icosahedral assemblies roughly 25 nm in diameter that closely match the computational design model was observed, confirming that the protein forms the designed multimeric assemblies. Scale bar is 50 nm.

Purified I3-01 eluted from the Superose 6 column as a single peak with an apparent size of about 60 subunits. In contrast, 1wa3-wt as well as a variant of I3-01 in which the leucine at position 33 was mutated to arginine [I3-01 (L33R)] both eluted in the expected trimeric state (FIG. 2). The L33R mutation was predicted to disrupt the designed 0 interface in I3-01 by introducing steric bulk that could not be accommodated. The observation that this mutation indeed disrupted assembly of I3-01 indicated that the designed O interface drives assembly of the protein to the designed icosahedral oligomeric assembly. We also observed that I3-01 migrates more slowly than 1wa3-wt and I3-01(L33R) during non-denaturing (native) polyacrylamide gel electrophoresis (PAGE) of the three proteins, which provided additional support that I3-01 self-assembles to a higher-order oligomerization state. Finally, visualization of I3-01 by cryo-electron microscopy revealed monodisperse particles of the expected size and shape (FIG. 3), and class averages derived from the cryo-electron micrographs closely resembled projections calculated from the I3-01 computational design model, demonstrating that I3-01 assembles to the designed icosahedral multimeric assembly in solution.

Design of Enveloped Multimeric Assemblies

We hypothesized that the minimal requirements for efficient release from cells of multimeric protein assemblies enveloped in a lipid bilayer membrane were threefold. First, the multimeric protein assembly must interact with a cellular membrane bilayer. Second, the multimeric protein assembly must deform the membrane to form a bud structure by virtue of its interaction with the membrane and its multimerization through the interactions of its 0 interfaces. Third, the multimeric protein assembly must recruit cellular factors such as the ESCRT complexes to catalyze the fission of the membrane neck between the bud and the cell, thereby effecting release of the multimeric protein assembly from the cell in the form of an enveloped protein nanoparticle. Protein constructs for providing multimeric protein assemblies comprising functional elements that meet all three criteria will hereafter be referred to as enveloped multimeric assemblies (FIG. 1). As described below, the constructs comprise proteins comprising M domains that interact with a cellular membrane, O interfaces that drive assembly of the multimeric protein assemblies and therefore membrane deformation, and L domains that recruit cellular factors for catalyzing membrane fission. As the examples below demonstrate, a variety of M domains, O interfaces, and L domains can be used, as long as each domain or interface demonstrably performs its required function and protein subunit of each multimeric protein assembly comprises at least one 0 interface and one L domain, and each multimeric protein assembly comprises at least one M domain.

A first series of constructs for providing enveloped multimeric assemblies was designed using the I3-01 polypeptide to provide the O interface. In this series of constructs, a variety of M domains and L domains were genetically fused to the I3-01 sequence.

In one embodiment (SEQ ID 227; Myr-I3-01-myc-p6), the N-terminal six amino acids of the HIV Gag protein were fused to the N terminus of I3-01 via a flexible linker to provide an M domain and the p6 domain of the HIV Gag protein was fused to the C terminus of I3-01 to provide an L domain; the construct also includes a myc tag to facilitate specific detection of the protein using anti-myc antibodies.

In another embodiment (SEQ ID 228; Late2-4GS-I3-01-10GS-PH-flag), 22 residues of the Ebola VP40 protein encompassing the polypeptide motif PTAPPEY, which is known to recruit the ESCRT pathway to facilitate the budding and release of Ebola from host cells, were fused to the N terminus of I3-01 to provide an L domain and the pleckstrin homology (PH) domain of the rat phospholipase C-δ1 protein was fused to the C terminus of I3-01 to provide an M domain; the construct also includes a FLAG tag to facilitate specific detection of the protein using anti-FLAG antibodies.

Initial Identification of Enveloped Multimeric Assemblies Using the Budding Assay To quantify release of I3-01-derived enveloped multimeric assemblies from cells, HEK293T cells ($8 \times 10^5$/well) were seeded in 6 well plates 24 h prior to transfection. Cells were transfected with 2.5 µg of plasmid DNA expressing I3-01-based constructs using LIPOFECTAMINE® 2000 (Invitrogen) following the manufacturer's instructions. Cells and culture supernatants were harvested 24 h post transfection. Enveloped multimeric assemblies were collected from the culture supernatants by centrifugation through a 20% sucrose cushion for 90 min at 21,000×g at 4° C. Cells were lysed in cold lysis buffer (50 mM Tris pH 7.4, 150 mM NaCl, 1% Triton X-100, protease inhibitors) and lysates were cleared by centrifugation for 5 min, 16,000×g, 4° C. Triton-insoluble material was solubilized in 2× Laemmli sample buffer by boiling for 10 min. The Triton-soluble and insoluble cellular fractions as well as the pelleted enveloped multimeric assemblies boiled in 1× Laemmli sample buffer were separated by 12% SDS-PAGE gels, transferred onto PVDF membranes, and probed with antibodies against the myc and/or FLAG tags. The presence of I3-01-based proteins in the culture supernatants pelleted through a 20% sucrose cushion suggests release of the proteins in the form of enveloped multimeric assemblies. Quantities of myc-tagged I3-01-based proteins in each fraction were measured using a standard curve generated with known amounts of recombinant, non-enveloped Myr-I3-01-myc-p6 protein produced in *E. coli*. Bacteria have neither ESCRT nor N-myristoyltransferase, both necessary for the budding and release of Myr-I3-01-myc-p6 as an enveloped multimeric assembly, and therefore Myr-I3-01-myc-p6 produced in *E. coli* forms a non-enveloped icosahedral multimeric assembly that resembles I3-01 by size exclusion chromatography and negative stain electron microscopy.

Whereas Myr-I3-01-myc-p6 and Late2-4GS-I3-01-10GS-PH-flag were found in the pelleted culture supernatants, unmodified I3-01 was not detectable in the pelleted culture supernatant. This result indicated that Myr-I3-01-myc-p6 and Late2-4GS-I3-01-10GS-PH-flag were released from cells as enveloped multimeric assemblies due to the additional functional domains they comprise relative to unmodified I3-01. Typical release levels for Myr-I3-01-p6 were roughly 100 µg/$10^6$ cells.

Although Myr-I3-01-myc-p6 was designed to comprise a myristoylation motif (the 6 N-terminal amino acids of HIV Gag) to function as the M domain on each protein subunit in the multimeric assembly, during the course of our characterization of the protein we discovered that the M domain was only present on about half of the protein subunits in each multimeric assembly. Myr-I3-01-myc-p6 migrates as two distinct but closely spaced bands (a "doublet") of equal intensity on SDS-PAGE or Western blots. Upon mutation of a methionine residue at the N terminal end of the I3-01 O interface to isoleucine, the new protein (EPN-01) migrated as a single band. This result demonstrates that the two bands observed in the Myr-I3-01-myc-p6 doublet were in fact two different molecules, one the full-length protein and one a truncated version of the same protein that lacked the N-terminal M domain and linker (SEQ ID NO: 317) due to the initiation of translation by the ribosome at the internal start codon. EPN-01—which bears the N-terminal M domain and linker on each subunit of the multimeric assembly—and Myr-I3-01-myc-p6 behave identically in terms of the ability to bud and be released from cells, package cargoes, be pseudotyped with viral envelope proteins, deliver cargoes to the cytoplasm of recipient cells, and appear to be indistinguishable structurally. This result demonstrates that not every subunit in a multimeric assembly needs to comprise an M domain, so long as the plurality of M domains in the multimeric assembly are adequate to drive association with the membrane and/or result in deformation of the lipid bilayer upon multimerization.

Figure 4:
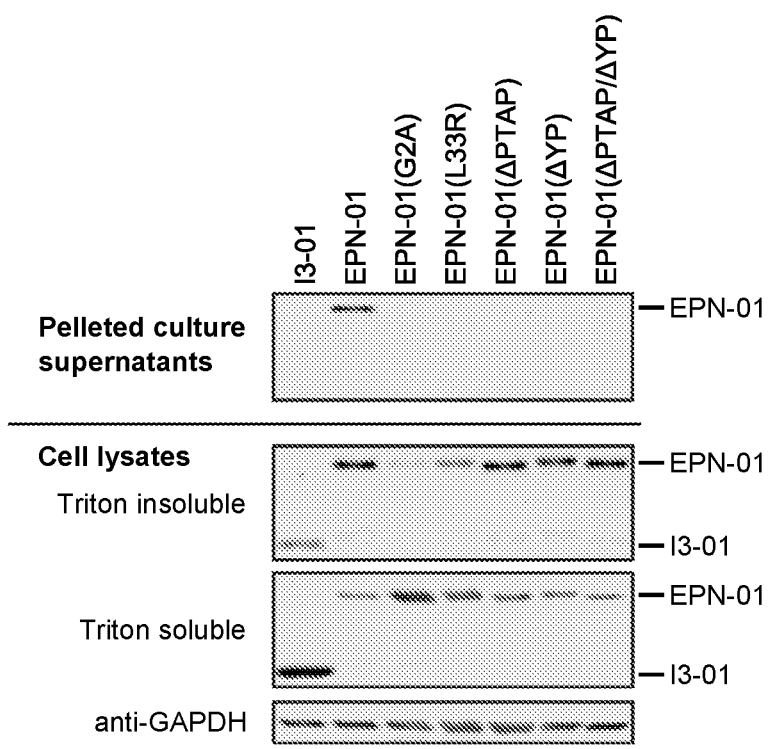
FIG. 4. Analysis of I3-01, EPN-01, and EPN-01 variants by the budding assay. Western blots of the cell lysates and pelleted culture supernatants are shown for various constructs (indicated by the column labels at the top of the blot). I3-01, which lacks M and L domains, was expressed in the cells as demonstrated by its presence in the cell lysates, but was not detected in the pelleted culture supernatants due to its inability to be released from cells. In contrast, EPN-01 was efficiently released from cells and pelleted through a 20% sucrose cushion. A very faint band for EPN-01 (APTAP) in the pelleted culture supernatant demonstrates that its ability to bud and be released from cells was severely reduced relative to that of EPN-01. The other EPN-01 mutants were undetectable in the pelleted culture supernatants in this particular experiment. Glyceraldehyde 3-phosphate dehydrogenase (GAPDH) was used as a loading control.

The budding and release of several mutants of EPN-01 were also evaluated using the budding assay described above in order to test the hypothesis that all three functions-membrane binding, multimerization, and recruitment of host factors for membrane scission—are necessary to effect efficient budding and release of enveloped multimeric assemblies. A G2A mutant of EPN-01 [Myr-I3-01-myc-p6(G2A)] that eliminates the ability of the M domain to be myristoylated (Freed E O, Orenstein J M, Buckler-White A J, Martin M A (1994) Single amino acid changes in the human immunodeficiency virus type 1 matrix protein block virus particle production. *J. Virol.* 68:5311-20) was used to test the requirement for membrane interaction. A variant containing the L33R mutation described above [EPN-01(L33R)] was used to test the requirement for higher-order multimerization to enhance membrane binding and/or induce membrane deformation. Three variants were made to test the requirement for recruitment of ESCRT to catalyze membrane fission. The p6 domain of the HIV Gag protein is known to contain at least two linear polypeptide motifs, PTAP (SEQ ID NO: 167) and YPLTSL (SEQ ID NO: 169), that respectively interact with Tsg101 and ALIX, proteins involved in the recruitment of proteins in the ESCRT pathway to the site of budding (McCullough J, Colf L A, Sundquist W I (2013) Membrane Fission Reactions of the Mammalian ESCRT Pathway. Annu. Rev. Biochem. 82:663-92; Bieniasz P D (2006) Late budding domains and host proteins involved in enveloped virus release. Virology 344:55-63). Therefore, variants in which the polypeptide motif PTAP (SEQ ID NO:167) was mutated to AAAA (SEQ ID NO: 316) [EPN-01(APTAP)], the YP dipeptide of the polypeptide motif YPLTSL (SEQ ID NO: 169) was mutated to AA [EPN-01 (AYP)], or both motifs were simultaneously mutated [EPN-01(APTAP/AYP)] were used to test the requirement for the recruitment of ESCRT to catalyze membrane fission. Mutation of these motifs in various retroviruses has been previously shown to disrupt ESCRT-dependent virus budding and release (Bieniasz P D (2006) Late budding domains and host proteins involved in enveloped virus release. Virology 344: 55-63, and references cited therein). Results of the budding assay with these variants of EPN-01 confirmed that the presence of all three functional elements is required for efficient budding and release of enveloped multimeric assemblies (FIG. 4). EPN-01(G2A) and EPN-01(L33R) were both undetectable in the pelleted culture supernatants, indicating that the functions of membrane binding and multimerization provided by the M domain and O interface are necessary for efficient budding and release. The release of EPN-01(ΔPTAP) from cells was significantly reduced, the release of EPN-01(ΔYP) was more significantly reduced, and the release of EPN-01(ΔPTAP/ΔYP) was undetectable, demonstrating that recruitment of ESCRT by an L domain comprising one or more polypeptide motifs known to interact directly or indirectly with proteins of the ESCRT pathway is also necessary for budding and release. Together, these results confirm the requirement for all three functional elements—membrane binding, multimerization, and recruitment of host factors for membrane scission—for efficient budding and release of enveloped multimeric assemblies.

(truncated variant of Myr-I3-01-myc-p6 lacking N-terminal M domain and linker)
SEQ ID 317
MEELFKKHKIVAVLRANSVEEAKKKALAVFLGGVHLIEITFTVPDADTVIK

ELSFLKEMGAIIGAGTVTSVEQCRKAVESGAEFIVSPHLDEEISQFCKEKG

VFYMPGVMTPTELVKAMKLGHTILKLFPGEVVGPQFVKAMKGPFPNVKFVP

TGGVNLDNVCEWFKAGVLAVGVGSALVKGTPVEVAEKAKAFVEKIRGCTE (QKLISEEDL)QSRPEPTAPPEESFRSGVETTTPPQKQEPIDKELYPLTS

LRSLFGNDPSSQ.

Visualization of Myr-I3-01-Myc-p6 and EPN-01 by Electron Cryo-Tomography (ECT)

Extracellular vesicles were purified from culture supernatants of HEK293T cells ($2 \times 10^6$ per 10 cm dish, up to 36 dishes seeded 24 h prior to transfection) that were transiently transfected with a plasmid encoding Myr-I3-01-myc-p6 or EPN-01 using $CaPO_4$. Transfected cells were incubated overnight before media was replaced with exosome production media (D-MEM supplemented with 10% FBS, depleted from contaminating extracellular particles by centrifugation overnight at 100,000×g at 4° C. and subsequently filtered through a 0.22 µm filter) and cells were grown for another 24 h. Extracellular vesicles released from cells were purified by a series of filtering and centrifugation steps (adapted from (Thery C, Clayton A, Amigorena S, Raposo G (2006) Isolation and Characterization of Exosomes from Cell and Culture Supernatants and Biological Fluids. Current Protocols in Cell Biology 3.22.1-3.22.19)). Cell debris was removed by centrifugation of the supernatant at 1,000×g for 5 min followed by filtering through a 0.22 µm filter. Extracellular vesicles were collected by centrifugation at 100,000×g in a SW32Ti (BeckmanCoulter) at 4° C. for at least 1 h. Pellets were resuspended in PBS and pooled in one tube (SW41 rotor, BeckmanCoulter). PBS was added to fill the tube completely and vesicles were collected by centrifugation at 100,000×g at 4° C. for at least 1 h. Pellets were resuspended in 1 ml of PBS and finally concentrated by centrifugation 100,000×g at 4° C. for at least 1 h in a tabletop ultracentrifuge using a TLS-55 rotor.

To prepare samples for ECT, 3 µl of purified vesicles in PBS were mixed with 3 µl of BSA coated gold fiducials (10 nm size, Electron Microscopy Sciences). 3.5 µl of the suspension was applied to a glow discharged 2/2 holey carbon coated EM grid (Quantifoil), which was previously placed in the environmental chamber of a Mark Vitrobot (FEI) maintained at 4° C., 80% relative humidity. Excess liquid was blotted for 7.5 s (0 mm offset) from the grids before plunge freezing in liquid ethane. Cryo-grids were then imaged in a 200 kV Tecnai TF20 microscope equipped with a K2 summit direct electron detector (Gatan). Tilt series were recorded bidirectionally starting from 0° to ±60° using a 1° step size at a magnification of 22,500× and a defocus of −8 µm (total dose per specimen was ~150e$^-$/Å). Image alignment and tomogram reconstructions were done using the IMOD software package (Kremer J. R., D. N. Mastronarde and J. R. McIntosh (1996) Computer visualization of three-dimensional image data using IMOD. J. Struct. Biol. 116:71-76).

Figure 5:
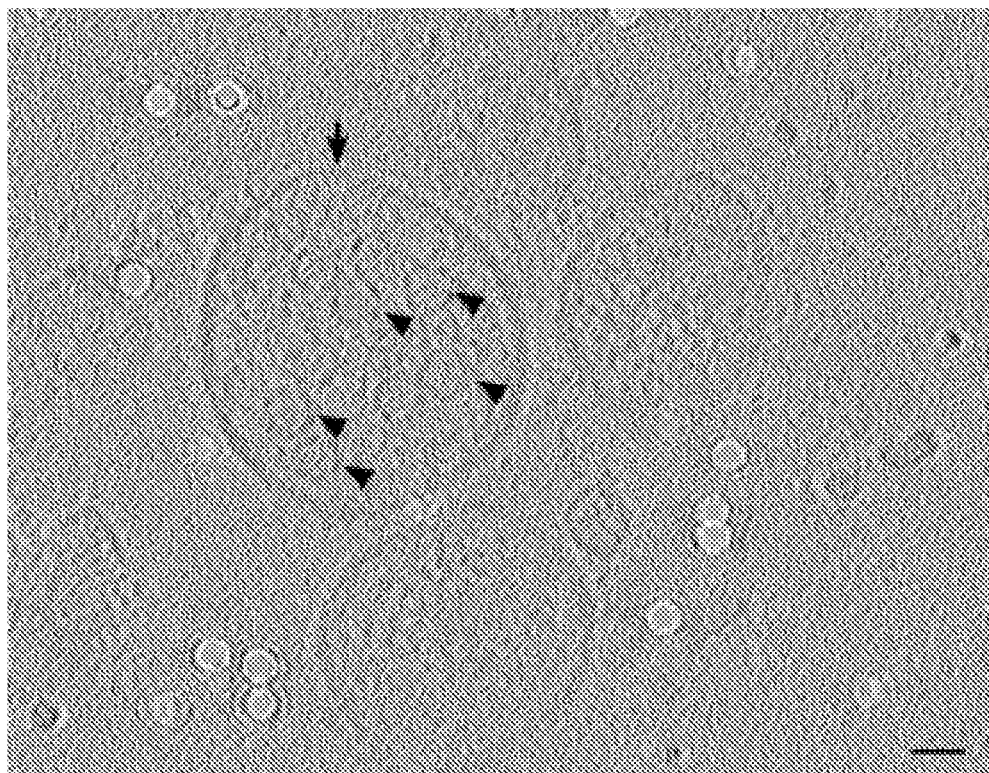
FIG. 5. Visualization of Myr-I3-01-myc-p6 enveloped multimeric assemblies by electron cryo-tomography. A representative image from an electron cryo-tomogram of Myr-I3-01-myc-p6 enveloped multimeric assemblies is shown. The image revealed multiple cage-like Myr-I3-01-myc-p6 multimeric assemblies approximately 25 nm in diameter (indicated by arrowheads) inside a larger membrane envelope (indicated by the arrow). Additional unmarked enveloped multimeric assemblies can be seen in the image. Scale bar is 25 nm.

Multiple icosahedral structures ~25 nm in diameter incorporated within larger membrane envelopes were observed in the pelleted culture supernatant from cells transfected with either Myr-I3-01-myc-p6 or EPN-01 (FIG. 5). The assemblies appear to be located primarily at the membrane of the vesicles, suggesting that they interact directly with the membrane via the M domain. Together with the results from the budding assay, these observations indicate that multimeric assemblies of Myr-I3-01-myc-p6 and EPN-01 are incorporated within large membrane-bounded vesicles that contain multiple multimeric assemblies.

Enveloped Multimeric Assemblies are Highly Modular

After our initial success in designing enveloped multimeric assemblies, we screened a large set of candidate enveloped multimeric assemblies (51 different constructs) to explore the modularity and generality of the platform. The first 48 EPN constructs all use I3-01 as the self-assembly or oligomerization (O) domain, but both the identities and locations of the membrane interaction (M) domain and the ESCRT recruitment (L) domain vary among the constructs. Various classes of membrane interaction domains were included in the set: myristoylation motifs, N-terminal palmitoylation motifs, C-terminal palmitoylation motifs, and four different types of globular protein domains that bind to various lipid polar head groups (PH, PX, Cl, and C2 domains). ESCRT recruitment domains used in the set vary from intact viral late domains (e.g., the p6 domain of HIV Gag) to peptide motifs as small as four amino acids known to play a key role in the protein-protein interactions that recruit ESCRT to sites of virus budding in vivo (e.g., PTAP). We also included in the set several constructs in which the L domain was omitted or mutations were made to inhibit membrane interactions in the M domain; these negative control constructs were not expected to bud and be released from cells as enveloped multimeric assemblies.

To facilitate the screening of the 51 constructs, we developed two biochemical assays that provide rapid assessments of both the yield of a given enveloped multimeric assembly as well as the integrity of the enveloped multimeric assembly membrane envelope. Both are based on the principle that an intact membrane envelope will prevent access of an added molecule to the protein subunits of the enveloped multimeric assembly, while the addition of detergent will enable access by disrupting the integrity of the membrane. In the first assay, trypsin was incubated with enveloped multimeric assemblies in the presence or absence of detergent and proteolysis of the protein subunits of the enveloped multimeric assembly was evaluated by Western blot. Lack of proteolysis in the sample without detergent indicated that the protein subunits of the enveloped multimeric assembly were not accessible to trypsin. Proteolysis in the presence of trypsin and detergent indicated that the protein subunits of the enveloped multimeric assembly are accessible to trypsin. Therefore, detergent-dependent proteolysis demonstrated that the membrane envelope was intact in the absence of detergent and responsible for preventing trypsin access. The second assay made use of a previously described spectrophotometric enzyme assay (Griffiths J S, Wymer N J, Njolito E, Niranjanakumari S, Fierke C A, Toone E J (2002), Bioorganic & Medicinal Chemistry 10:545-50). The assay was specific for enveloped multimeric assemblies comprising I3-01 as the oligomerization (O) domain because it takes advantage of the fact that I3-01 was designed using a trimeric KDPG aldolase as the scaffold protein and the enzymatic activity is retained in the icosahedral multimeric assembly. Because the substrate KDPG is unable to cross lipid membranes, detergent-dependent enzymatic activity provided another readout for membrane integrity.

The day of transfection, 1 mL of HEK293F (Invitrogen) cells were plated at 2.5×10⁶ cells/mL in 12-well plates. Cells were transfected with 1 µg of plasmid DNA encoding enveloped multimeric assembly constructs using EXPI-FECTAMINE® 293 Reagent (Invitrogen) following the manufacturer's instructions. Cells and culture supernatants were harvested 40-48 h post transfection by centrifugation at 1000×g for 5 min at 4° C. to pellet the cells. Culture supernatants were then filtered through 0.45 µm filters (Millipore) and enveloped multimeric assemblies were collected by centrifugation through a 20% sucrose cushion for 2 h at 21,000×g at 4° C. Pelleted enveloped multimeric assemblies were resuspended in phosphate buffered saline (PBS). For the protease assay, aliquots of the resuspended enveloped multimeric assemblies were incubated for 30 min at room temperature with Trypsin-EDTA (Gibco) with the trypsin at a final concentration of 50 µg/mL in the presence or absence of 1% Triton X-100 (Sigma). After 30 min, freshly prepared phenylmethanesulfonyl fluoride (PMSF) trypsin inhibitor was added to trypsin-containing samples to a final concentration of 1 mM. Samples of the cell pellets, resuspended enveloped multimeric assemblies, enveloped multimeric assemblies+trypsin, and enveloped multimeric assemblies+trypsin+triton were mixed with Laemmli Sample Buffer, boiled for 10 minutes at 95° C., and analyzed by Western blot using an anti-myc primary antibody (9B11, Cell Signaling Technology). The enzyme assay was performed in 25 mM HEPES pH 7.0, 20 mM NaCl in the presence of NADH (0.1 mM), L-lactate dehydrogenase (0.11 U/µt), and 2-keto-3-deoxy-6-phosphogluconate (KDPG, 1 mM) at 25° C. Aliquots of the resuspended enveloped multimeric assemblies were added to reaction mixtures in the presence or absence of 1% Triton X-100 and enzyme activity was measured by monitoring the loss of absorbance at 339 nm due to oxidation of the NADH cofactor.

Figure 6:
FIG. 6. Analysis of EPN-49, EPN-50, and EPN-51 by the protease assay. Western blots of various EPN-49, EPN-50, and EPN-51 samples are shown. All three proteins express as shown by the bands observed in the cell pellet samples. The lack of bands for EPN-50 and EPN-51 in any of the pelleted culture supernatant samples indicated that these proteins are not released from cells as enveloped multimeric assemblies. EPN-51, in contrast, is released into the culture supernatant as an enveloped multimeric assembly. Incubation of EPN-51 enveloped multimeric assemblies with trypsin revealed that the membrane envelope protected the protein from degradation. When the membrane envelope was disrupted by the addition of Triton X-100, trypsin gained access to the protein and degraded it, as shown by the absence of a band in this lane. The experiment indicates that in the absence of detergent, the membrane envelope of the enveloped multimeric assemblies was intact and provided a protective barrier that prevented access of trypsin to the protein.

Screening of the first 48 enveloped multimeric assemblies that use I3-01 as the oligomerization (O) domain using the protease and enzyme activity assays described above demonstrated that 22 of the enveloped multimeric assemblies were released from cells in enveloped form with intact membrane envelopes (Table 3). Another 9 enveloped multimeric assemblies were released into the cell supernatant but did not appear to have fully intact membrane envelopes (that is, access of trypsin and/or KDPG to the subunits of the multimeric assemblies was detergent-independent); the reason for this is currently unclear. 17 out of the first 48 enveloped multimeric assembly constructs failed to be released into the cell supernatant; of these, 5 were designed as negative controls and were intended to not be released. The three constructs that use O3-33 as the oligomerization (O) domain were also evaluated using the protease assay described above. One (EPN-49) was a negative control not intended to bud and be released from cells; one (EPN-50) was not released from cells; and one (EPN-51) was released from cells, pelleted through a 20% sucrose cushion, and underwent detergent-dependent proteolysis by trypsin, demonstrating that it formed an enveloped multimeric assembly of the invention (FIG. 6). The 23 successful enveloped multimeric assemblies we have identified clearly demonstrate that the enveloped multimeric assemblies of the invention are general and highly modular in the sense that a wide variety of functional groups (M domains, O interfaces, and L domains) can be used to readily design new enveloped multimeric assemblies. Additionally, as described above, the inventors have provided assays that can be used to identify the enveloped multimeric assemblies of the invention.

TABLE 3

Summary of results from enzyme assay analyzing Myr-I3-01-myc-p6, I3-01, and EPNs 01-48.

| Construct | Enzyme activity | Conclusion |
| --- | --- | --- |
| Myr-I3-01-myc-p6 | Detergent-dependent | Released from cells as an enveloped multimeric assembly of the invention |
| I3-01 (negative control) | None | Not released from cells |
| EPN-01 | Detergent-dependent | Released from cells as an enveloped multimeric assembly of the invention |
| EPN-02 (negative control) | None | Not released from cells |
| EPN-03 | Detergent-dependent | Released from cells as an enveloped multimeric assembly of the invention |
| EPN-04 | None | Not released from cells |
| EPN-05 | None | Not released from cells |
| EPN-06 | None | Not released from cells |
| EPN-07 | Detergent-dependent | Released from cells as an enveloped multimeric assembly of the invention |
| EPN-08 | Detergent-dependent | Released from cells as an enveloped multimeric assembly of the invention |
| EPN-09 | Detergent-dependent | Released from cells as an enveloped multimeric assembly of the invention |
| EPN-10 | Detergent-independent | Released from cells without an intact membrane |
| EPN-11 | Detergent-dependent | Released from cells as an enveloped multimeric assembly of the invention |
| EPN-12 | None | Not released from cells |
| EPN-13 | Detergent-independent | Released from cells without an intact membrane |
| EPN-14 | Detergent-independent | Released from cells without an intact membrane |
| EPN-15 | None | Not released from cells |
| EPN-16 | None | Not released from cells |
| EPN-17 (negative control) | None | Not released from cells |
| EPN-18 | Detergent-dependent | Released from cells as an enveloped multimeric assembly of the invention |
| EPN-19 | Detergent-independent | Released from cells without an intact membrane |
| EPN-20 | Detergent-dependent | Released from cells as an enveloped multimeric assembly of the invention |
| EPN-21 | Detergent-independent | Released from cells without an intact membrane |
| EPN-22 | Detergent-independent | Released from cells without an intact membrane |
| EPN-23 | Detergent-dependent | Released from cells as an enveloped multimeric assembly of the invention |
| EPN-24 | Detergent-dependent | Released from cells as an enveloped multimeric assembly of the invention |
| EPN-25 | Detergent-dependent | Released from cells as an enveloped multimeric assembly of the invention |
| EPN-26 | Detergent-independent | Released from cells without an intact membrane |
| EPN-27 (negative control) | None | Not released from cells |
| EPN-28 | None | Not released from cells |
| EPN-29 | Detergent-independent | Released from cells without an intact membrane |
| EPN-30 (negative control) | None | Not released from cells |
| EPN-31 | None | Not released from cells |
| EPN-32 | None | Not released from cells |

TABLE 3-continued

Summary of results from enzyme assay analyzing
Myr-I3-01-myc-p6, I3-01, and EPNs 01-48.

| Construct | Enzyme activity | Conclusion |
| --- | --- | --- |
| EPN-33 (negative control) | None | Not released from cells |
| EPN-34 | None | Not released from cells |
| EPN-35 | Detergent-independent | Released from cells without an intact membrane |
| EPN-36 | Detergent-dependent | Released from cells as an enveloped multimeric assembly of the invention |
| EPN-37 | Detergent-dependent | Released from cells as an enveloped multimeric assembly of the invention |
| EPN-38 | Detergent-dependent | Released from cells as an enveloped multimeric assembly of the invention |
| EPN-39 | Detergent-dependent | Released from cells as an enveloped multimeric assembly of the invention |
| EPN-40 | None | Not released from cells |
| EPN-41 | Detergent-dependent | Released from cells as an enveloped multimeric assembly of the invention |
| EPN-42 | Detergent-dependent | Released from cells as an enveloped multimeric assembly of the invention |
| EPN-43 | Detergent-dependent | Released from cells as an enveloped multimeric assembly of the invention |
| EPN-44 | Detergent-dependent | Released from cells as an enveloped multimeric assembly of the invention |
| EPN-45 | None | Not released from cells |
| EPN-46 | Detergent-dependent | Released from cells as an enveloped multimeric assembly of the invention |
| EPN-47 | Detergent-dependent | Released from cells as an enveloped multimeric assembly of the invention |
| EPN-48 | Detergent-dependent | Released from cells as an enveloped multimeric assembly of the invention |

BlaM Protein Delivery Assay

The ability of the enveloped multimeric assemblies to package and deliver a protein cargo to the cytoplasm of recipient cells was evaluated using a modified version of the beta-lactamase (BlaM) delivery assay originally developed by Cavrois et al. to measure the membrane fusion event effected by the HIV envelope protein (Cavrois M, de Naronha C, Greene W C (2002), Nat. Biotech. 20:1151-4). In the original version of the assay, a chimeric protein in which BlaM is fused to the HIV Vpr protein (SEQ ID 203; BlaM-Vpr) is co-expressed with DNA encoding HIV virions or virus-like particles in mammalian cells. A non-covalent, protein-protein interaction between Vpr and the p6 domain of the HIV Gag protein results in incorporation of the BlaM-Vpr fusion protein in enveloped virions or virus-like particles that bud and are released from the cell surface. The BlaM-Vpr-containing enveloped virions or virus-like particles can then be added to recipient cells, upon which the envelope protein binds to its target receptor, facilitating cellular uptake and fusion of the viral or VLP membrane with cellular membranes, thereby releasing the virion with its BlaM-Vpr cargo into the cytosol. The recipient cells are treated with the fluorescent dye CCF2-AM, which contains two fluorophores that make an efficient FRET pair connected by a beta-lactam ring. If BlaM (or, in this case, BlaM-Vpr) is present in the cytosol of the cells, it will cleave the CCF2-AM substrate, resulting in a change of the fluorescence emission maximum from 520 nm to 447 nm. This change in the fluorescence signal can be detected using a variety of instruments capable of detecting fluorescent signals, including but not limited to spectrophotometers, fluorimeters, plate readers, and flow cytometers.

In our modified version of the BlaM delivery assay, enveloped Myr-I3-01-myc-p6 or EPN-01 multimeric assemblies replaced the HIV virions or virus-like particles in packaging and facilitating the entry of BlaM-Vpr into the recipient cells. Although a wide variety of potential packaging moieties could be used to package BlaM into enveloped multimeric assemblies, the p6 domain of Myr-I3-01-myc-p6 (SEQ ID 186) in combination with the Vpr domain of the BlaM-Vpr fusion protein (SEQ ID 203) served as a convenient and effective packaging moiety. In other embodiments, other polypeptide sequences known to interact with a cargo of interest could be used to package the cargo. In other embodiments, packaging moieties selected from the set disclosed herein and in the attached appendices could be used to package a cargo of interest. In addition, because the Myr-I3-01-myc-p6 polypeptide does not comprise a polypeptide domain capable of facilitating cell entry and membrane fusion, we pseudotyped the enveloped multimeric assemblies with a viral fusion protein by co-expression in the producer cells. A wide variety of viral fusion proteins could be used to facilitate cell entry and membrane fusion. In one embodiment, the glycoprotein from vesicular stomatitis virus (VSV-G) was incorporated into the membrane envelope of Myr-I3-01-myc-p6 enveloped multimeric assemblies. In other embodiments, a protein selected from the set of known viral envelope proteins and sequences disclosed herein and in the attached appendices could be used to facilitate cell entry and membrane fusion.

Myr-I3-01-myc-p6 enveloped multimeric assemblies packaging the BlaM-Vpr fusion protein and pseudotyped with VSV-G were produced by co-transfecting HEK293T cells ($5 \times 10^6$ cells in a 10 cm dish seeded 24 h prior to transfection) with 9 µg of pCMV-Myr-I3-01-myc-p6 DNA, 5 µg of myc-BlaM-Vpr expression construct (derived from pMM310) (Cavrois M, de Naronha C, Greene W C (2002), Nat. Biotech. 20:1151-4; Tobiume, M., et al., J Virol, 2003. 77(19): p. 10645-50), and 1 µg VSV-G-myc expression construct (derived from pCMV-VSV-G) (Yee, J. K., T. Friedmann, and J. C. Burns, Methods in cell biology, 1994. 43 Pt A: p. 99-112; Olsen, J. C., Gene transfer vectors derived from equine infectious anemia virus. Gene Ther, 1998. 5(11): p. 1481-7) using LIPOFECTAMINE® 2000 (Invitrogen). Enveloped multimeric assemblies were harvested by centrifugation though a 20% sucrose cushion (24,000 rpm in a SW41Ti rotor [BeckmanCoulter], 2 h, 4° C.) 24-36 h post transfection. The amounts of the Myr-I3-01-myc-p6, BlaM-Vpr, and VSV-G proteins incorporated into the enveloped multimeric assemblies were quantified by Western blotting.

For the BlaM delivery assay, either $2 \times 10^4$ cells/well were seeded in a 96 well plate or $1 \times 10^5$ cells were seeded in a 24 well plate. 24 h later, a serial dilution of standardized quantities of enveloped nanoparticles were added to the cells and incubated for 2 h at 37° C. and 5% $CO_2$. After two hours, enveloped multimeric assembly-containing supernatants were replaced by CCF2-AM-labelling media prepared according to the manufacturer's instructions (Invitrogen). Cells were labeled for 16 h at 13° C. and assayed for a change in fluorescence emission spectrum from green (520 nm) to blue (447 nm) by flow cytometry (FACSCanto, BD Biosciences).

Figure 7:
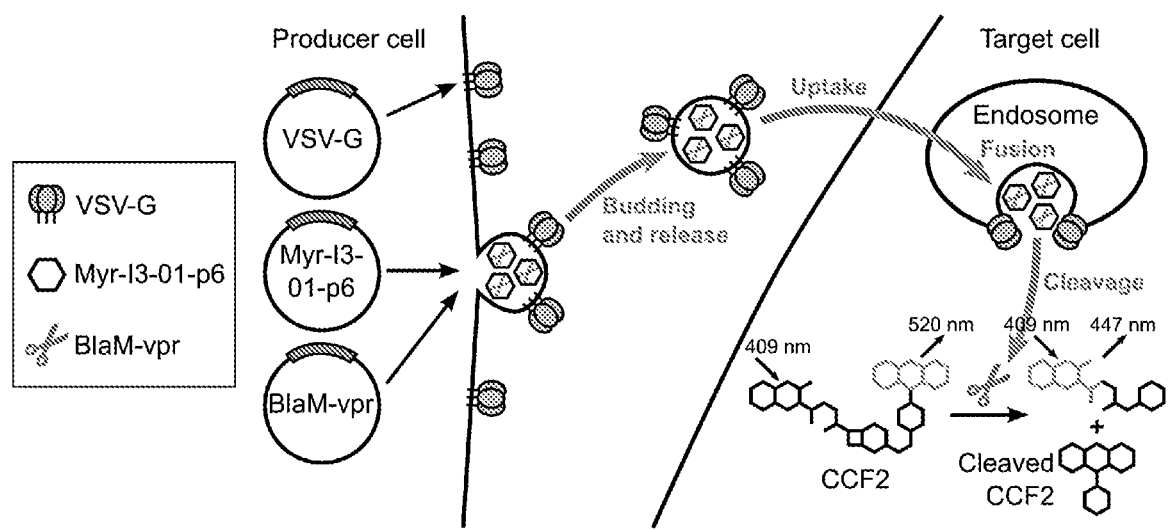
FIG. 7. Schematic of the beta lactamase (BlaM) delivery assay. The image depicts the production of BlaM-packaging, VSV-G-bearing enveloped multimeric assemblies that deliver the BlaM-vpr fusion protein to the cytoplasm of recipient or target cells. Plasmids encoding VSV-G, Myr-I3-01-myc-p6, and BlaM-vpr are co-transfected into a "producer" cell. Production of the three proteins results in the budding and release of enveloped multimeric assemblies that contain the BlaM-vpr cargo within the lumen of their membrane envelopes and VSV-G as a transmembrane protein within the membrane envelope itself. The VSV-G facilitates uptake in the target cell and fusion of the enveloped multimeric assembly membrane with cellular (e.g., endosomal) membranes. Membrane fusion results in the delivery of the packaged BlaM-vpr cargo to the cytoplasm of the target cell, where it cleaves the CCF2 dye, resulting in a change in fluorescence emission from 520 nm to 447 nm that can easily be monitored using a variety of instruments.
Figure 8:
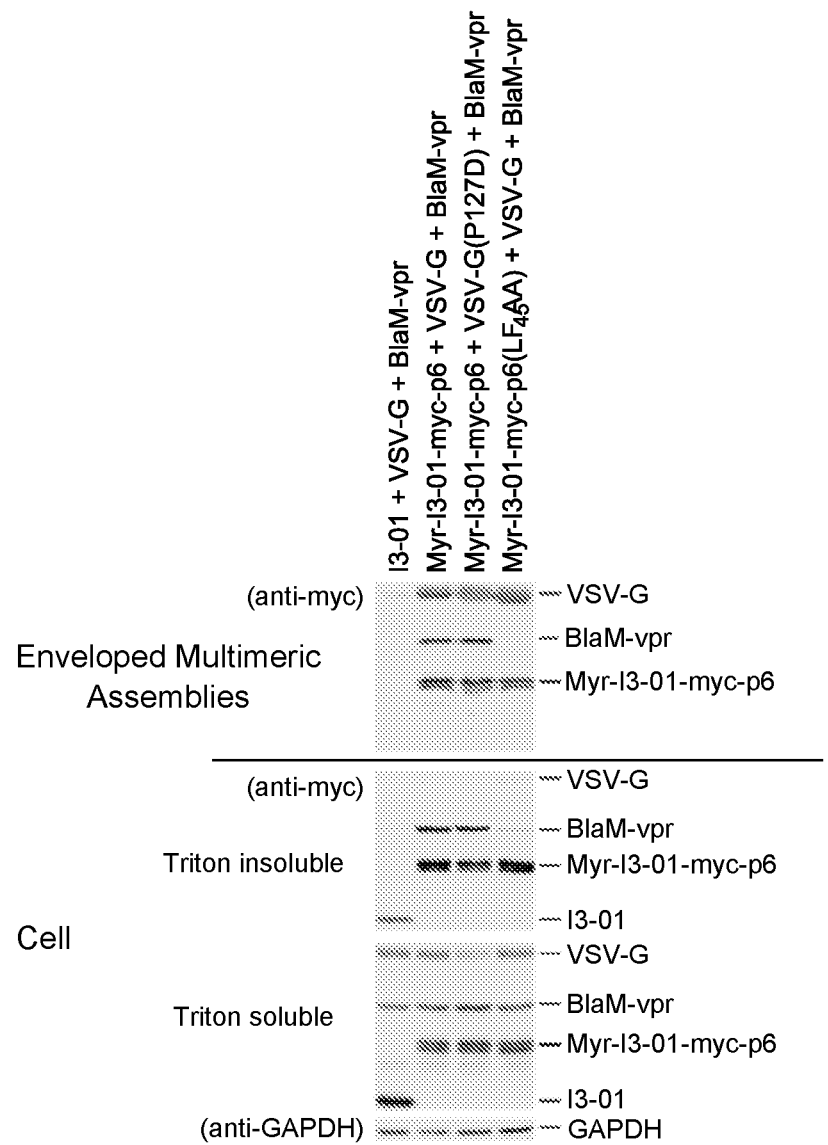
FIG. 8. Analysis of BlaM delivery assay samples by Western blot. Western blots of various enveloped multimeric assemblies and corresponding cell lysates are shown. The proteins expressed in four separate co-transfections are indicated by the column labels at the top of the blot. The first column in the blot reveals that all three proteins—VSV-G, I3-01, and BlaM-vpr—were expressed in the cells but failed to be released into the culture supernatants due to the lack of M and L domains in I3-01. The second and third columns demonstrate that when Myr-I3-01-myc-p6 was expressed instead of I3-01, all three proteins—VSV-G or VSV-G (P127D), BlaM-vpr, and Myr-I3-01-myc-p6—were released into the cell culture supernatant as enveloped multimeric assemblies. The fourth column shows that mutation of the vpr binding site in the packaging moiety of Myr-I3-01-myc-p6 [Myr-I3-01-myc-p6($LF_{45}AA$)] severely reduced the amount of BlaM-vpr cargo packaged in the enveloped multimeric assemblies. GAPDH was used as a loading control.
Figure 9:
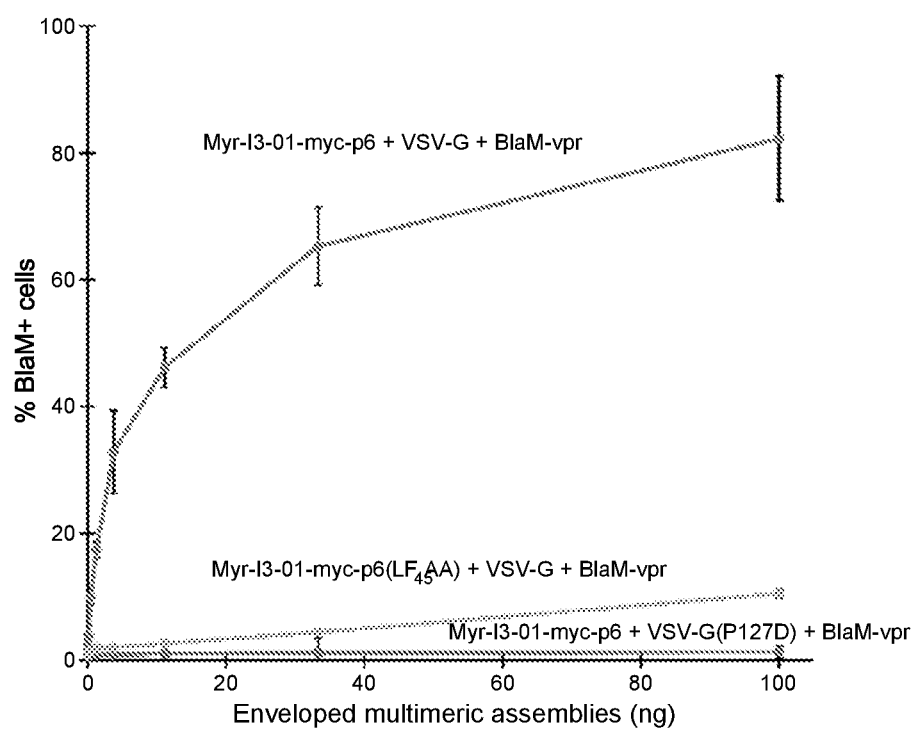
FIG. 9. Cytoplasmic delivery of BlaM-vpr by enveloped multimeric assemblies. The percentage of BlaM-positive (BlaM+) cells in a sample (measured by flow cytometry) is plotted as a function of the amount of enveloped multimeric assemblies administered to the cells. The three set of points correspond to the three enveloped multimeric assemblies analyzed by Western blot in FIG. 8. Enveloped multimeric assemblies produced by co-transfection of plasmids encoding Myr-I3-01-myc-p6, VSV-G, and BlaM-vpr yielded efficient, dose-dependent delivery of BlaM-vpr to the cytoplasm of recipient cells. The enveloped multimeric assemblies in which Blam-vpr cargo packaging was disrupted by mutation of the packaging moiety [Myr-I3-01-myc-p6($LF_{45}AA$)+VSV-G+BlaM-vpr] yielded severely reduced BlaM-vpr delivery. Finally, the enveloped multimeric assemblies bearing a VSV-G mutant incapable of effecting membrane fusion [Myr-I3-01-myc-p6+VSV-G (P127D)+BlaM-vpr] yielded no detectable BlaM delivery, demonstrating that cytoplasmic delivery is required in order to observe cleavage of the fluorescent substrate.

The BlaM delivery assay was performed using Myr-I3-01-myc-p6 enveloped multimeric assemblies packaging BlaM-Vpr and pseudotyped with VSV-G (FIG. 7). The incorporation of Myr-I3-01-myc-p6, BlaM-Vpr, and VSV-G in the enveloped multimeric assemblies was confirmed by Western blotting (FIG. 8). Replacing Myr-I3-01-myc-p6 with I3-01, which lacks the membrane interaction and ESCRT recruitment domains required for budding and release as an enveloped multimeric assembly, resulted in no VSV-G or BlaM-Vpr in the pelleted culture supernatants. Recipient cells treated with increasing amounts of Myr-I3-01-myc-p6 enveloped multimeric assemblies packaging BlaM-Vpr and pseudotyped with VSV-G showed a dose-dependent increase in the number of BlaM-positive cells (FIG. 9). In contrast, significant numbers of BlaM-positive cells were not observed for enveloped multimeric assemblies that were either: 1) pseudotyped with a mutant VSV-G incapable of membrane fusion [VSV-G(P127D) (SEQ ID NO: 307)] or lacked significant levels of packaged BlaM-Vpr owing to the use of a Myr-I3-01-myc-p6 mutant that disrupted the non-covalent interface between p6 and Vpr [Myr-I3-01-myc-p6(LF$_{45}$AA) (SEQ ID NO: 318)]. Together, these results demonstrate that Myr-I3-01-myc-p6 enveloped multimeric assemblies that packaged BlaM-Vpr and were pseudotyped with VSV-G delivered the BlaM-Vpr protein to the cytoplasm of the recipient cells via VSV-G-mediated membrane fusion.

(Myr-I3-01-myc-p6(LF45AA))
SEQ ID 318
(M)GARASGSKSGSGSDSGSKMEELFKKHKIVAVLRANSVEEAKKKALAVF

LGGVVHLIEITFTVPDADTVIKELSFLKEMGAIIGAGTVTSVEQCRKAVESG

AEFIVSPHLDEEISQFCKEKGVFYMPGVMTPTELVKAMKLGHTILKLFPGE

VVGPQFVKAMKGPFPNVKFVPTGGVNLDNVCEWFKAGVLAVGVGSALVKGT

PVEVAEKAKAFVEKIRGCTE(QKLISEEDL)QSRPEPTAPPEESFRSGVET

TTPPQKQEPIDKELYPLTSLRSAAGNDPSSQ

Packaging mRNA Cargoes into Enveloped Multimeric Assemblies

We designed and evaluated a series of constructs intended to package messenger RNA (mRNA) cargoes within the membrane envelope of the enveloped multimeric assemblies of the invention. For each of the four mRNA packaging moieties disclosed herein (SEQ IDs 198, 199, 200, 201), four constructs were made—direct genetic fusions to either EPN-01-posT1 (SEQ ID 229) or EPN-01 (SEQ ID 230), and a "frameshift" variant of each fusion in which the packaging domain is expected to be included in only a fraction of the protein molecules produced owing to the presence of a frameshift element in the gene (SEQ IDs 254, 255, 256, 257, 258, 259, 260, 261, 262, 263, 264, 265, 266, 267, 268, 269). The frameshift element, located in the linker between EPN-01 and the packaging domain, was derived from HIV Gag-Pol and causes the ribosome to undergo a −1 frameshift during roughly 5-10% of its encounters with the frameshift element during mRNA translation (Biswas P, Jiang X, Pacchia A L, Dougherty J P, Peltz S W (2004), J. Virol. 78:2082-7). The frameshift sequences were designed such that a successful frameshift would result in translation of the RNA packaging moiety, so that 5-10% of the protein subunits would be expected to comprise the packaging moiety as a genetic fusion. The four packaging moieties tested were all polypeptide motifs or domains that have been shown to bind preferentially to a specific RNA recognition sequence (SEQ IDs 204, 205, 206, 207; Gosser Y, Hermann T, Majumdar A, Hu W, Frederick R, Jiang F, Xu W, Patel D J (2001), Nat. Struct. Biol. 8:146-50; Oubridge C, Ito N, Evans P R, Teo C H, Nagai K (1994), Nature 372:432-8; De Guzman R N, Wu Z R, Stalling C C, Pappalardo L, Borer P N, Summers M F (1998), Science 279:384-8; Puglisi J D, Chen L, Blanchard S, Frankel A D (1995), Science 270: 1200-3). We also designed expression plasmids encoding mRNA cargo molecules (SEQ IDs 208, 209, 210, 211, 212, 213, 214, 215, 216, 217, 218, 219) that contained the corresponding recognition sequences both upstream (5') and downstream (3') of a reporter construct [either beta lactamase (BlaM) or GFP]. Upon co-expression of a multimeric assembly bearing a packaging moiety and the mRNA cargo bearing the cognate recognition sequence, the interaction between the packaging moiety and the recognition sequence should recruit the mRNA cargo to the multimeric assembly, resulting in its packaging within the membrane envelope of the enveloped multimeric assembly. We used reverse transcription quantitative polymerase chain reaction (RT-qPCR) to detect and determine relative concentrations of packaged mRNA cargoes.

Plasmids encoding the packaging moiety-bearing proteins and the mRNA cargoes were co-transfected into 1.25× 10$^8$HEK293F cells using EXPIFECTAMINE® (Invitrogen) according to the manufacturer's instructions. 40 hours after transfection, cells were pelleted by centrifugation at 1500×g for 5 min, and enveloped multimeric assemblies were purified from the supernatant by filtration through a 0.45 filter and pelleting through a 20% sucrose cushion as described above. The enveloped multimeric assemblies were resuspended in phosphate buffered saline (PBS). In some experiments, the enveloped multimeric assemblies were treated with RNase A, Triton X-100, or both prior to detection of packaged mRNA by RT-qPCR. Relative RNA levels were analyzed by RT-qPCR as follows. RNA was extracted from enveloped multimeric assemblies by mixing 100 µL of enveloped multimeric assemblies with 500 µL Trizol and freezing overnight. The next day, 100 µL of chloroform was added to the thawed sample and the tube was shaken vigorously before centrifugation at 20,000×g for 10 minutes at 4° C. Next, 200 µL of aqueous phase was mixed with 200 µL of 100% ethanol and purified using a Qiagen RNEASY® kit according to the manufacturer's protocols. The purified RNA was eluted in 45 µL distilled water (dH$_2$O) and treated with 5 µL of 10× Turbo DNase buffer and 1 µL of Turbo DNase at 37° C. for 20 minutes. DNase was then removed by purifying the RNA with Ampure RNAclean XP beads according to the manufacturer's protocols and eluting in 30 µL dH$_2$O. A reverse transcription primer compatible with all mRNA cargoes tested (CATACTGTTGGTTGCTAGGC (SEQ ID NO: 319)) was annealed to the purified RNA by incubation of the following reaction at 65° C. for 5 minutes: 2 µL RNA, 1 µL reverse transcription primer (unless otherwise noted, all primer stock concentrations were 10 µM), 6 µL dH$_2$O, 0.5 µL 0.1 M DTT, and 0.5 µL SUPERase-In RNase Inhibitor. For the detection of mitochondrial RNA, the reverse transcription primer was substituted with primers specific to cytochrome c oxidase subunit I (GCTGTGAC-GATAACGTTGTAGATG (SEQ ID NO: 320)) or cytochrome c oxidase subunit II (GGACGATGGCAT-GAAACTG (SEQ ID NO: 321)). Reverse transcription was performed with the following reaction using a THERMO-SCRIPT® Reverse Transcriptase kit (ThermoFisher Scientific): 5 µL of hybridization reaction, 2 µL cDNA synthesis buffer, 0.5 µL 0.1 M DTT, 0.5 µL SUPERASE®-In RNase Inhibitor, 1 µL 10 mM dNTPs, and 1 µL THERMO- SCRIPT® Reverse Transcriptase. Negative controls were also performed in which the reverse transcriptase was replaced with dH$_2$O. The reverse transcription reaction was performed at 52° C. for 1 hour followed by heat inactivation at 80° C. for 5 minutes. The crude cDNA was then used as template in a qPCR reaction: 5 µL 2× Kapa HIFI HOT-START® READY MIX®, 0.5 µL SYBR green, 0.5 µL forward primer TAGGATTACTGCTCGGTGAC (SEQ ID NO: 322), 0.5 µL reverse primer CCAAATAGGATGTGT-GCGAC (SEQ ID NO: 323), 2.5 µL dH2O, and 1 µL cDNA. For amplification of mitochondrial cDNAs, the primers were substituted with primers specific to cytochrome c oxidase subunit I (forward: CCACAAAGACATTGGAACAC-TATACC (SEQ ID NO: 324); reverse: GCTGTGACGA-TAACGTTGTAGATG (SEQ ID NO: 325)) or cytochrome c oxidase subunit II (forward: CCTTATCTGCTTCCTAGTC-CTGTATG (SEQ ID NO: 326); reverse: GGAC-GATGGGCATGAAACTG (SEQ ID NO: 327)). The thermocycler program was 3 minutes at 95° C. followed by 29 cycles of 20 seconds at 98° C., 15 seconds at 64° C., 90 seconds at 72° C., and the SYBR® green signal was then read.

Analysis of enveloped multimeric assemblies bearing the nucleic acid packaging domains described herein by RT-qPCR revealed the presence of packaged mRNA cargoes within the membrane envelopes of the enveloped multimeric assemblies. The enveloped multimeric assemblies based on EPN-01 in which the packaging moieties were included in 5-10% of the protein subunits due to the frameshift element yielded lower levels of mRNA cargo incorporation than those in which the packaging moiety was fused directly to EPN-01, suggesting that higher numbers of packaging moieties assist in the packaging of more mRNA cargoes. In contrast, the direct fusion and the frameshift constructs based on EPN-01-posT1 yielded similarly high levels of mRNA cargo incorporation, suggesting that the high number of positively charged residues on the interiors of the multimeric assemblies was able to drive packaging of the mRNA cargoes irrespective of the number of copies of the packaging moiety.

Figure 10:
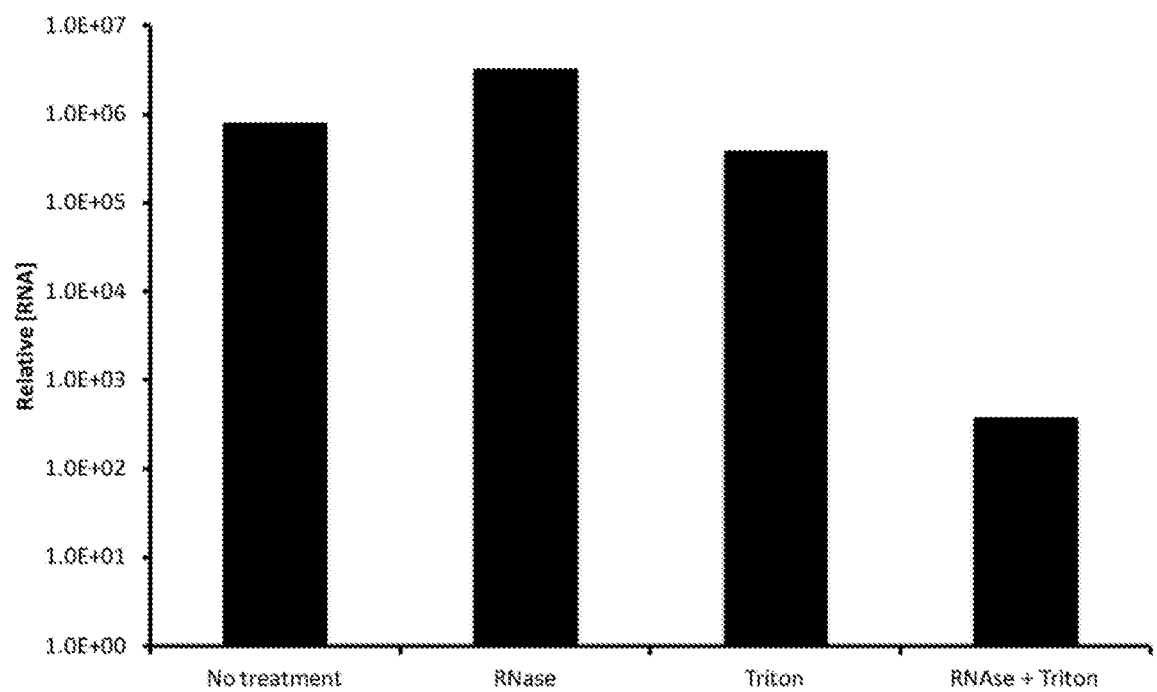
FIG. 10. Protection of packaged mRNA cargoes from RNase by enveloped multimeric assemblies. Relative levels of mRNA cargoes as measured by RT-qPCR are shown. The enveloped multimeric assemblies were incubated in various conditions prior to RT-qPCR analysis. In the "no treatment" sample, the enveloped multimeric assemblies were incubated in phosphate buffered saline only; this sample provides a baseline measurement of packaged mRNA cargoes. The "RNase" sample was incubated with 20 µg/uL of RNase A for 10 minutes; no degradation of the packaged mRNA cargoes was observed because the membrane envelope of the enveloped multimeric assemblies provides an effective barrier preventing access of RNase to the cargoes. Incubation of the enveloped multimeric assemblies with 1% Triton X-100 for 10 minutes ("Triton") had no effect on mRNA cargo stability as expected. Incubation of the enveloped multimeric assemblies with 20 µg/uL of RNase A and 1% Triton X-100 for 10 minutes resulted in a more than 1,000-fold reduction in the amount of intact mRNA cargoes due to disruption of the membrane envelope, allowing access of RNase to the cargoes.

Experiments in which the enveloped multimeric assemblies were challenged with detergent, RNase A, or both prior to analysis by RT-qPCR demonstrated that the packaged mRNA is contained within the membrane envelope of the enveloped multimeric assemblies. These experiments were similar to the protease and enzyme activity assays described above in that they evaluated the accessibility of the mRNA cargoes to RNase A in the presence and absence of detergent. A mixture of four pooled mRNA-packaging enveloped multimeric assemblies [produced from four different co-transfections with plasmids encoding the four EPN-01-posT1 constructs (SEQ IDs 256, 260, 264, and 268) and corresponding mRNA cargoes (SEQ IDs 208, 209, 210, and 211)] yielded similar levels of mRNA cargoes after incubation in PBS for 10 minutes (no treatment), incubation with 20 µg/mL RNase A for 10 minutes, or incubation with 1% Triton X-100 for 10 minutes prior to RT-qPCR (FIG. 10). In contrast, the level of packaged mRNA cargo was depleted by more than three orders of magnitude when the same mixture of mRNA-packaging enveloped multimeric assemblies was incubated with 20 µg/mL RNase A and 1% Triton X-100 for 10 minutes prior to RT-qPCR. This detergent-dependent degradation of the mRNA cargoes by RNase demonstrated that the membrane envelope of the enveloped multimeric nanoparticles provides an effective barrier that protects the packaged mRNA cargoes from degradation. In other experiments, we have observed no degradation of packaged mRNA cargoes when the RNase incubation is extended to 16 hours (in the absence of detergent).

Control experiments in which we analyzed enveloped multimeric assemblies for the presence of mitochondrial RNAs demonstrated that they are free of cellular (or mitochondrial) contamination. Mitochondrial mRNAs encoding cytochrome c oxidase subunits I and II were readily detected by RT-qPCR of the cell pellets of cells expressing the enveloped multimeric particles. In contrast, the same mRNAs were not detectable in the purified enveloped multimeric assemblies. This result demonstrates that the packaged and protected mRNA cargoes we observed in the experiments described above were not present inside cells contaminating the enveloped multimeric assemblies, but were in fact packaged within the membrane envelopes of the enveloped multimeric assemblies.

Figure 11:
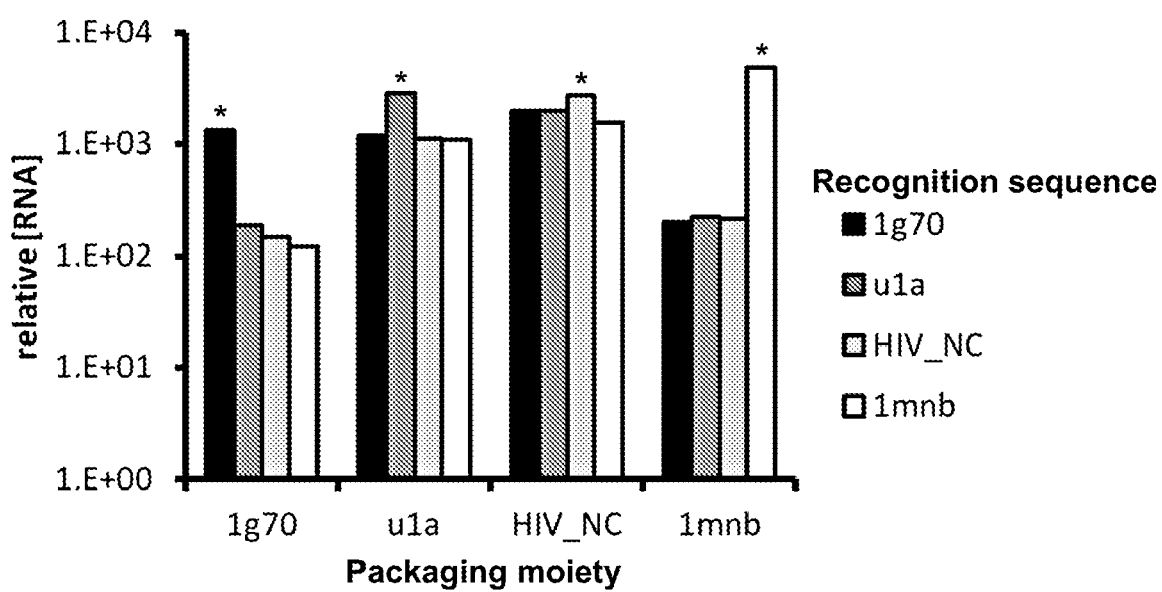
FIG. 11. All-against-all comparison of mRNA packaging moieties and recognition sequences. The relative levels of packaged mRNA cargoes in various enveloped multimeric assemblies as measured by RT-qPCR are shown. 16 different enveloped multimeric assemblies were produced by co-transfection of a plasmid encoding a protein comprising one of four RNA packaging domains (indicated on the x axis) and a plasmid encoding an mRNA cargo comprising one of four recognition sequences (indicated by the legend). The data show that each packaging domain packaged more of the cargo comprising the cognate recognition sequence (bars indicated by *) than non-cognate recognition sequences, and suggest that the 1g70 and 1 mnb packaging moiety/recognition sequences pairs may provide the greatest packaging specificity.

We further analyzed the interactions between the packaging moieties and their cognate recognition sequences by performing an all-against-all comparison. Each of the four constructs in which the packaging domains disclosed herein were fused to EPN-01-posT1 (SEQ IDs 256, 260, 264, and 268) was co-transfected with plasmids encoding the four different versions of an mRNA cargo comprising the four recognition sequences disclosed herein (SEQ IDs 208, 209, 210, and 211) for a total of 16 co-transfections. The yield of packaged mRNA cargo from each resulting enveloped multimeric assembly was assessed by RT-qPCR as described above. While all four RNA binding domains showed the highest packaging yield for the mRNA cargoes bearing their cognate recognition sequences, the 1g70 and 1 mnb RNA packaging moieties exhibited the highest specificity (FIG. 11).

Packaging Cytoplasmic Cargoes in Enveloped Multimeric Assemblies

Recently, it was shown that enveloped viruses such as HIV and influenza can package small organic molecules—specifically, 2',3'-cyclic GMP-AMP (cGAMP)—from the host cell cytoplasm, and that the packaged cGAMP is capable of inducing the type I interferon response in the cells they go on to infect (Gentili M, et al. (2015), Science 349:1232-6; Bridgeman A, et al. (2015), Science 349:1228-32). cGAMP is a second messenger synthesized by the cytosolic DNA-sensing protein cyclic GMP-AMP synthase (cGAS) as part of the recently discovered cGAS-STING innate immune pathway that activates the type I interferon response (Sun L, Wu J, Du F, Chen X, Chen Z J (2013), Science 339:786-91; Wu J, Sun L, Chen X, Du F, Shi H, Chen C, Chen Z J (2013), Science 339:826-30). In the non-limiting embodiments described below, the inventors have shown that cGAMP can be packaged within the lumen of the membrane envelope of the enveloped multimeric assemblies of the invention and, if the enveloped multimeric assemblies also comprise a protein capable of mediating membrane fusion, the packaged cGAMP can be delivered to the cytoplasm of recipient cells, where it induces a functional interferon response by binding to and activating STING. From these data, those of skill in the art will recognize the ability of the enveloped multimeric assemblies of the invention to package other types of molecules, such as proteins, nucleic acids, lipids, or other small organic molecules, from the cytoplasm of the cell in which they are produced.

cGAMP-loaded enveloped multimeric assemblies were prepared by transfecting ~2.5×10$^6$ HEK293T cells in a 1.0-cm tissue culture dish with 6 µg of plasmid encoding either EPN-01-posT1 or Myr-I3-01-myc-p6, 10 µg plasmid encoding human cGAS, and 1.5 µg plasmid encoding either VSV-G or the ecotropic envelope protein of Murine Moloney Leukemia Virus (Eco). Control transfections were also performed in which one or more of the plasmids was omitted. HEK293T cells are known to not express cGAS; therefore, cGAMP production requires expression of recombinant cGAS. HEK293T cell culture supernatants were harvested 36-48 hours after transfection and filtered through a 0.45 μm filter, In some experiments, enveloped multimeric assemblies were pelleted by centrifugation through a 20% sucrose cushion at 70,000×g, resuspended in 100 μl PBS, and diluted in complete media (DMEM supplemented with 10% fetal bovine serum). In the experiments described below, the filtered supernatants were used directly to administer the enveloped multimeric assemblies to macrophages. The ability of the enveloped multimeric assemblies to package and deliver cGAMP was evaluated using a macrophage stimulation assay as follows. Primary murine bone marrow-derived macrophages were cultured from the following mice: C57BL6L1 (wild-type), cGAS$^{-/-}$ (Mb21d1$^{-/-}$; Gray E E, Trueting P M, Woodward J J, Stetson D B (2015), J. Immunol. 195:1939-43), or Tmem173$^{-/-}$ (STING-deficient; Ishikawa H, Barber G N (2008), Nature 455:674-8). Macrophages were incubated with cGAMP-loaded or control enveloped multimeric assemblies for 6-8 hours. Type interferons in culture supernatants from stimulated macrophages were quantified using an interferon bioassay in which L929 cells expressing an interferon-stimulated response element (ISRE)-luciferase reporter were incubated with macrophage culture supernatants for 6 hours. L929-ISRE reporter cells were lysed and luciferase activity was quantified using a Luciferase Assay System (Promega) and Centro LB 960 Microplate Luminometer (Berthold Technologies). In this assay, luciferase activity is correlated with the concentration of interferons in the macrophage supernatants, which is in turn proportional to the amount of bioactive cGAMP delivered to the macrophage cytoplasm by the enveloped multimeric assemblies.

Figure 12:
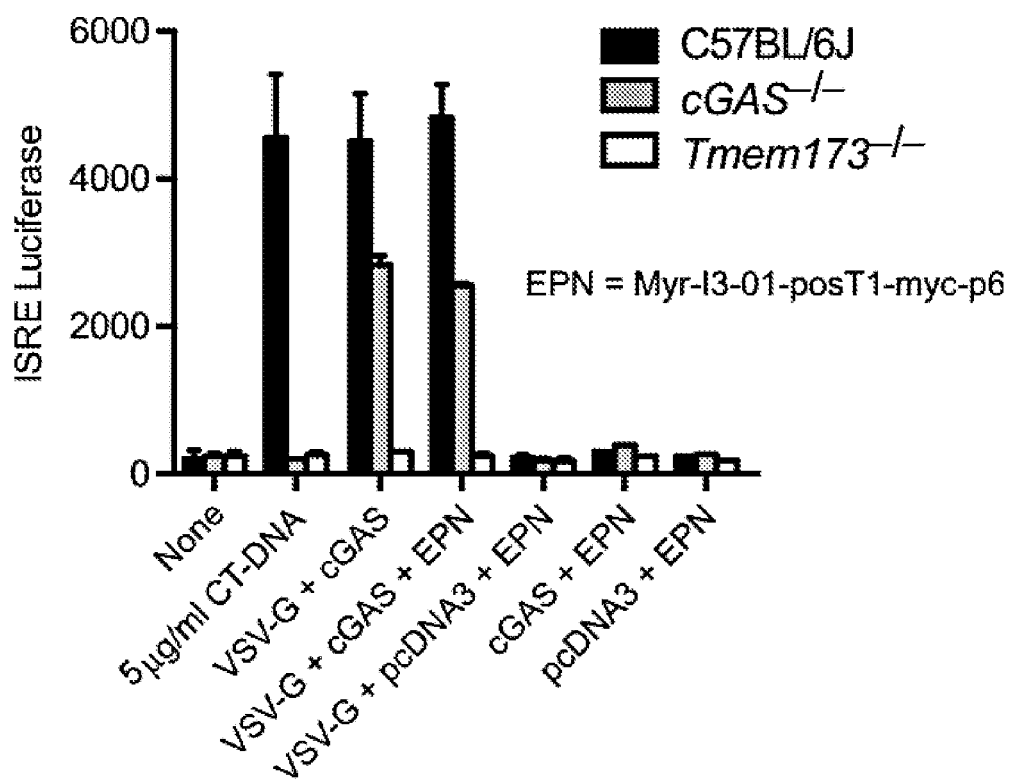
FIG. 12. Cytoplasmic delivery of packaged cyclic GMP-AMP (cGAMP) by enveloped multimeric assemblies. Luciferase activities from lysed reporter cells after treatment with supernatants from macrophages stimulated with various enveloped multimeric assemblies are shown. Bars of different colors indicate activity measured using macrophages derived from wild-type (C57BL/6J), cGAS-deficient (cGAS-/-) or STING-deficient (Tmem173-/-) mice. The data show that enveloped multimeric assemblies packaging cGAMP and pseudotyped with VSV-G (VSV-G+cGAS+EPN) induced an interferon response in macrophages that is dependent on STING but independent of cGAS. VSV-G-induced extracellular vesicles were also capable of packaging and delivering cGAMP (VSV-G+cGAS), while several negative controls in which various plasmids were omitted from the co-transfections yielded no activity. Calf-thymus DNA (CT-DNA) transfected into the macrophages was used as a positive control.
Figure 13:
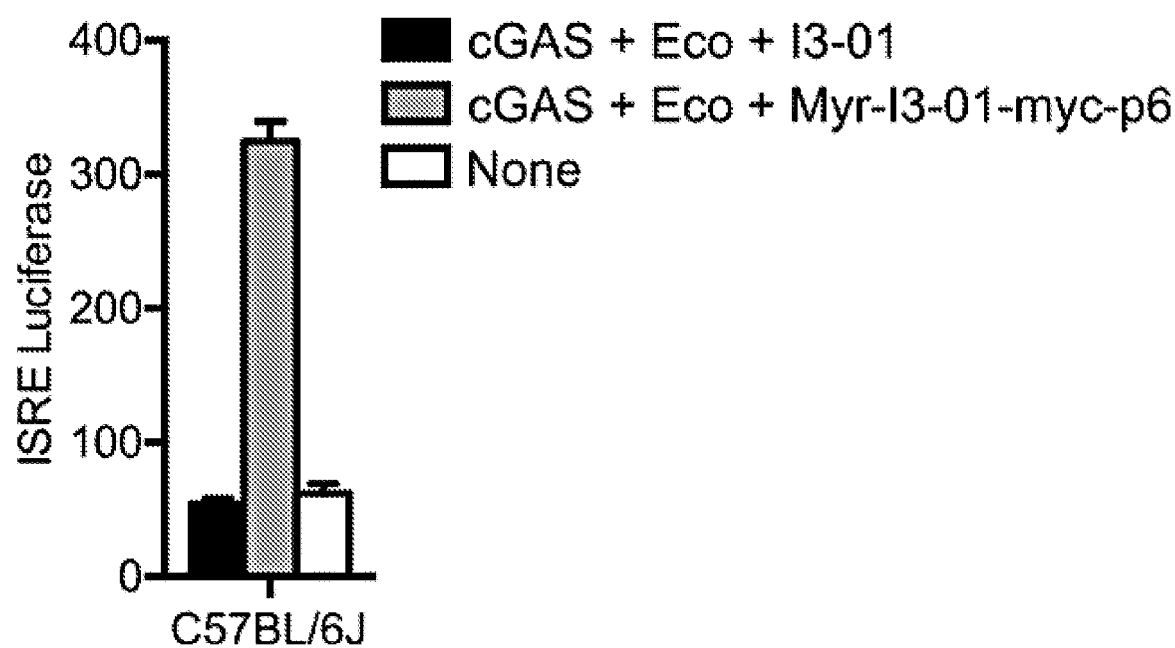
FIG. 13. Enveloped multimeric assemblies are required for cGAMP delivery using the ecotropic envelope protein from Moloney Murine Leukemia Virus (Eco). Supernatants from cells expressing cGAS+Eco+Myr-I3-01-myc-p6 enveloped multimeric assemblies induced an interferon response in macrophages from wild-type (C57BL/6J) mice. Supernatants from cells in which Myr-I3-01-myc-p6 was substituted with I3-01, which does not result in the production of enveloped multimeric assemblies, failed to induce an interferon response.

In a first set of experiments, we used VSV-G as the envelope protein that mediates fusion of the enveloped multimeric assembly membrane with recipient cell membranes (FIG. 12). Enveloped multimeric assemblies prepared from HEK293T cells expressing EPN-01-posT1, cGAS, and VSV-G induced interferon production in wild-type macrophages roughly equivalent to that of transfected calf thymus DNA, a commonly used positive control for measuring cGAS- and STING-dependent innate immune responses. The same enveloped multimeric assemblies also induced a strong interferon response in cGAS-deficient macrophages, suggesting that the stimulus associated with the enveloped multimeric assemblies responsible for inducing interferon production was not DNA. In contrast, interferon production was reduced to background levels in STING-deficient macrophages. The cGAS-independent, STING-dependent nature of the response strongly suggests that the enveloped multimeric assembly-associated stimulus was cGAMP, the known activating ligand of STING. Additional controls confirmed this suggestion: enveloped multimeric assemblies produced in cells that did not express cGAS, VSV-G, or both failed to induce interferon production in any macrophages. Together, these data show that the stimulus for interferon production was dependent on expression of cGAS and dependent on the presence of a protein capable of mediating membrane fusion. Interestingly, filtered supernatants from cells expressing cGAS and VSV-G, but not EPN-01-posT1, induced interferon production in wild-type and cGAS-deficient cells but not STING-deficient cells in a manner closely resembling the behavior of enveloped multimeric assemblies produced in cells expressing all three proteins. Given the known ability of VSV-G to induce the formation of extracellular vesicles on its own (Mangeot P, Dollet S, Girard M, Ciancia C, Joly S, Peschanski M, Lotteau V (2011) Protein transfer into human cells by VSV-G-induced nanovesicles. Mol. Therapy 19:1656-66), we hypothesized that VSV-G-induced extracellular vesicles were packaging and delivering cGAMP in a manner similar to the enveloped multimeric assemblies. We therefore evaluated the ability of an alternative envelope protein, that of the Moloney Murine Leukemia Virus (Eco), which is not known to induce extracellular vesicle formation upon expression in human cells, to mediate cytoplasmic delivery of packaged cGAMP. Enveloped multimeric assemblies prepared from HEK293T cells expressing Myr-I3-01-myc-p6, cGAS, and Eco induced an interferon response in wild-type macrophages, while those prepared from HEK293T cells expressing cGAS and Eco with I3-01, which we have shown does not produce enveloped multimeric assemblies (see above), did not induce interferon production (FIG. 13). This experiment demonstrated that in the absence of background vesicles derived from VSV-G-induced vesicle formation, a functional enveloped multimeric assembly protein was required in order to mediate the packaging and delivery of cGAMP to recipient cells via the enveloped multimeric assemblies of the invention. Taken together, the results of the macrophage stimulation assays described here demonstrate that the enveloped multimeric assemblies of the invention package cGAMP and deliver it to the cytoplasm of the recipient cells, where it stimulates a functional interferon response. The lack of any known interactions between cGAMP and the protein subunits of the enveloped multimeric assembly, in combination with similar packaging and delivery of cGAMP by both enveloped viruses and VSV-G-derived extracellular vesicles (described above), establishes that packaging of cGAMP inside the membrane envelope of the enveloped multimeric assemblies is the result of the packaging of a volume of host cell cytoplasm which contains cGAMP rather than specific recruitment of cGAMP to the enveloped multimeric assemblies by a packaging moiety. As will be known to those of skill in the art, this property of the enveloped multimeric assemblies enables the packaging of a variety of molecules present in the host cell cytoplasm, including but not limited to proteins, nucleic acids, lipids, and other small organic molecules.

(human eGAS)

SEQ ID 328

ME(QKLISEEDL)QPWHGKAMQRASEAGATAPKASARNARGAPMDPTESPAAPEAA

LIPKAGKFGPARKSGSRQKKSAPDTQERPPVRATGARAKKAPQRAQDTQPSDATSAP

GAEGLEPPAAREPALSRAGSCRQRGARCSTKPRPPPGPWDVPSPGLPVSAPILVRRDA

APGASKLRAVLEKLKLSRDDISTAAGMVKGVVDHLLLRLKCDSAFRGVGLINTGSY

-continued

```
YEHVKISAPNEFDVMFKLEVPRIQLEEYSNTRAYYFVKFKRNPKENPLSQFLEGEILS

ASKMLSKFRKIIKEEINDIKDTDVBIKRICRGGSPAVTLLISEKISVDITLALESKSSWPA

STQEGLRIQNWLSPVKAIRKQLRLKPFYLVPKITAKEGNGFQEETWRLSFSHIEKEILNN

HGKSKTCCENKEEKCCRKDCLKLMKYLLEQLKERFKDKKHLDKFSSYFIVICTAFFH

VCTQNPQDSQWDRKDLGLEFDNCVTYFLQCLATEKLENYFIPEFINLFSSNLIDKRSKE

FLTKQIEYERNNEFPVFDEF (Ecotropic envelope protein from Moloney
Murine Leukemia Virus or "Eco")
                                                SEQ ID 308
MARSTLSKPLKNICVNTRGPLIPLTILLMLRGVSTASPGSSPHQVYNITWEVTNGDRETV

WATSGNHPLWIWWPDLTPDLCMLAHHGPSYWGLEYQSPFSSPPGPPCCSGGSSPGC

SRDCEEPLTSLTPRCNTAWNRLKLDQTTHIKSNEGFYVCPGPHRPRESKSCGGPDSFY

CAYWGCETTGRAYWKPSSSWDFITVNNNLTSDQAVQVCKDNKWCNPLVERFTDAG

RRVTSWTTGFIYAVGLRLYVSGQDPGLTFGIRLRYQNLGPRVPIGPNPVLADQQPLSKP

KPVICSPSVTKPPSGTPLSPTQLPPAGTEIVRLLNLVDGAYQA.LNLTSPDKTQECWLCL

VAGPPYYEGVAVLGTYSNHTSAPANCSVASQHKLTLSEVTGQGLCIGAVPKTHQAL

CNTTQTSSRGSYYLVAPTGTMWACSTGLTPCISTTILNLTTDYCVLVELWPRVTYHS

PSYVYGUERSNRILIKREPVSUILALLLGGLTMGGIAAGIGTGTTALMATQQFQQLQA

AVQDDLREVEKSISNLEKSLTSLSEVVLQNRRGLDLLFLKEGGLCAALKEECCFYAD

HTGLYRDSMAKLRERLNQRQKLFESTQGWFEGLFNRSPWFTILTSTIMGPLIVIIMIL

LFGPCILNRLVQFVKDRISVVQALTQQYHQLKPIEYEP
```

SEQUENCE LISTING (328 sequences)

SEQ ID NO: 1 - protein, 184 aa, Artificial Sequence
  Synthetic
  MISC_FEATURE (1)..(1): optionally absent
  MISC_FEATURE (2)..(3): Xaa is any amino acid
  MISC_FEATURE (11)..(11): Xaa is any amino acid
  MISC_FEATURE (25)..(25): Xaa is any amino acid
  MISC_FEATURE (28)..(28): Xaa is any amino acid
  MISC_FEATURE (30)..(30): Xaa is any amino acid
  MISC_FEATURE (35)..(35): Xaa is any amino acid
  MISC_FEATURE (38)..(39): Xaa is any amino acid
  MISC_FEATURE (41)..(41): Xaa is any amino acid
  MISC_FEATURE (49)..(50): Xaa is any amino acid
  MISC_FEATURE (55)..(55): Xaa is any amino acid
  MISC_FEATURE (68)..(70): Xaa is any amino acid
  MISC_FEATURE (72)..(72): Xaa is any amino acid
  MISC_FEATURE (75)..(76): Xaa is any amino acid
  MISC_FEATURE (78)..(79): Xaa is any amino acid
  MISC_FEATURE (83)..(83): Xaa is any amino acid
  MISC_FEATURE (86)..(88): Xaa is any amino acid
  MISC_FEATURE (90)..(90): Xaa is any amino acid
  MISC_FEATURE (92)..(95): Xaa is any amino acid
  MISC_FEATURE (103)..(103): Xaa is any amino acid
  MISC_FEATURE (114)..(114): Xaa is any amino acid
  MISC_FEATURE (117)..(117): Xaa is any amino acid
  MISC_FEATURE (120)..(120): Xaa is any amino acid
  MISC_FEATURE (127)..(127): Xaa is any amino acid
  MISC_FEATURE (130)..(130): Xaa is any amino acid
  MISC_FEATURE (133)..(133): Xaa is any amino acid
  MISC_FEATURE (143)..(143): Xaa is any amino acid
  MISC_FEATURE (162)..(162): Xaa is any amino acid
  MISC_FEATURE (171)..(172): Xaa is any amino acid
  MISC_FEATURE (174)..(175): Xaa is any amino acid
  MISC_FEATURE (178)..(179): Xaa is any amino acid
  MISC_FEATURE (183)..(184): Xaa is any amino acid
MXXAIGILELXSIAAGMELGDAMLXSAXVXLLVSXTIXXGXFLLMLGGXXGAIQXAIETGTSQAGELXXXSXVLXXIXXSVLXAIXXXNXVXXXXAVGIVETXSVAACISAADXAVXGSXVTLVRVXMAXGIXGKCYMVVAGXVSDVALAVTVASSSAGAYXLLVYASLIXXPXXAMXXQMVXX

SEQ ID NO: 2 - protein, 184 aa, Artificial Sequence
  Synthetic
  MISC_FEATURE (1)..(1): optionally absent
MSQAIGILELTSIAKGMELGDAMLKSANVDLLVSKTICPGKFLLMLGGDIGAIQQAIETGTSQAGEMLVDSLVLANIHPSVLPAISGLNSVDKRQAVGIVETWSVAACISAADRAVKGSNVTLVRVHMAFGIGGKCYMVVAGDVSDVNNAVTVASESAGEKGLLVYRSVIPRPHEAMWRQMVEG

SEQ ID NO: 3 - protein, 184 aa, Artificial Sequence
  Synthetic
  MISC_FEATURE (1)..(1): optionally absent
MSQAIGILELTSIAAGMELGDAMLKSANVDLLVSKTISPGKFLLMLGGDIGAIQQAIETGTSQAGELLVDSLVLANIHPSVLPAISGLNSVDKRQAVGIVETWSVAACISAADRAVKGSNVTLVRVHMAFGIGGKCYMVVAGDVSDVALAVTVASSSAGAYGLLVYASLIPRPHEAMWRQMVEG

SEQ ID NO: 4 - protein, 199 aa, Artificial Sequence
  Synthetic
  MISC_FEATURE (1)..(1): optionally absent
  MISC_FEATURE (2)..(10): Xaa is any amino acid
  MISC_FEATURE (13)..(13): Xaa is any amino acid
  MISC_FEATURE (16)..(16): Xaa is any amino acid
  MISC_FEATURE (19)..(19): Xaa is any amino acid
  MISC_FEATURE (21)..(21): Xaa is any amino acid
  MISC_FEATURE (41)..(41): Xaa is S or V
  MISC_FEATURE (42)..(42): Xaa is any amino acid
  MISC_FEATURE (44)..(44): Xaa is L or M
  MISC_FEATURE (45)..(45): Xaa is K or M
  MISC_FEATURE (46)..(46): Xaa is any amino acid
  MISC_FEATURE (58)..(59): Xaa is any amino acid
  MISC_FEATURE (61)..(61): Xaa is any amino acid
  MISC_FEATURE (75)..(75): Xaa is any amino acid
  MISC_FEATURE (78)..(79): Xaa is any amino acid
  MISC_FEATURE (92)..(92): Xaa is any amino acid
  MISC_FEATURE (94)..(94): Xaa is any amino acid
  MISC_FEATURE (97)..(97): Xaa is any amino acid
  MISC_FEATURE (111)..(111): Xaa is any amino acid
  MISC_FEATURE (114)..(114): Xaa is any amino acid
  MISC_FEATURE (116)..(118): Xaa is any amino acid
  MISC_FEATURE (121)..(121): Xaa is any amino acid
  MISC_FEATURE (123)..(123): Xaa is any amino acid
  MISC_FEATURE (125)..(125): Xaa is any amino acid
  MISC_FEATURE (130)..(130): Xaa is any amino acid
  MISC_FEATURE (148)..(148): Xaa is any amino acid
  MISC_FEATURE (151)..(151): Xaa is any amino acid
  MISC_FEATURE (163)..(164): Xaa is any amino acid
  MISC_FEATURE (166)..(168): Xaa is any amino acid
  MISC_FEATURE (172)..(172): Xaa is any amino acid
  MISC_FEATURE (175)..(175): Xaa is any amino acid
  MISC_FEATURE (177)..(181): Xaa is any amino acid
  MISC_FEATURE (183)..(183): Xaa is any amino acid
  MISC_FEATURE (185)..(186): Xaa is any amino acid
MXXXXXXXXXKWXDAXFDXTXINERLRAKVICFALNHTNPXXTXXXKVLIDALFQTTXXNXSISIPFDTDYGWNXKLXXNVYVNTNCYFMDXGXITXGDNVFIGPNCGFYXATXPXXXHHXNXGXEKAGXIHIGSNTWFGGHVAVLPXVTXGEGSVIGAGSVXXKXXXPHSXAVXNXXXXXRXIXXDLPSETLNDETIK

SEQ ID NO: 5 - protein, 199 aa, Artificial Sequence
  Synthetic
  MISC_FEATURE (1)..(1): optionally absent
MTEKEKMLAEKWYDANFDQYLINERARAKDICFELNHTRPSATNKRKELIDQLFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 6 - protein, 184 aa, Artificial Sequence; identical to SEQ ID NO: 2
  Synthetic
  MISC_FEATURE (1)..(1): optionally absent

SEQ ID NO: 7 - protein, 199 aa, Artificial Sequence
  Synthetic
  MISC_FEATURE (1)..(1): optionally absent
MTEKEKMLAEKWYDANFDQTLINERLRAKVICFALNHTNPSATLKRKVLIDALFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 8 - protein, 199 aa, Artificial Sequence
  Synthetic
  MISC_FEATURE (1)..(1): optionally absent
MTEKEKMLAEKWYDANFDQTLINERLRAKVICFALNHTNPVATMMRKVLIDALFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 9 - protein, 199 aa, Artificial Sequence
  Synthetic
  MISC_FEATURE (1)..(1): optionally absent
  MISC_FEATURE (41)..(41): Xaa is S or V
  MISC_FEATURE (44)..(44): Xaa is L or M
  MISC_FEATURE (45)..(45): Xaa is K or M
MTEKEKMLAEKWYDANFDQTLINERLRAKVICFALNHTNPXATXXRKVLIDALFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 10 - protein, 159 aa, Artificial Sequence
  Synthetic
  MISC_FEATURE (1)..(1): optionally absent
MGEVPIGDPKELNGMEIAAVYLQPIEMEPRGIDLAASLADIHLEADIHALKNNPNGFPEGFWMPYLTIAYALANADTGAIKTGTLMPMVADDGPHYGANIAMEKDKKGGFGVGTYALTFLISNPEKQGFGRHVDEETGVGKWFEPFVVTYFFKYTGTPK

SEQ ID NO: 11 - protein, 184 aa, Artificial Sequence
  Synthetic
  MISC_FEATURE (1)..(1): optionally absent
MSQAIGILELTSIAKGMELGDAMLKSANVDLLVSKTISPGKFLLMLGGDIGAIQQAIETGTSQAGEMLVDSLVLANIHPSVLPAISGLNSVDKRQAVGIVETWSVAACISAADLAVKGSNVTLVRVHMAFGIGGKCYMVVAGDVLDVAAAVATASLAAGAKGLLVYASIIPRPHEAMWRQMVEG

SEQ ID NO: 12 - protein, 103 aa, Artificial Sequence
  Synthetic
  MISC_FEATURE (1)..(1): optionally absent
MEEVVLITVPSALVAVKIAHALVEERLAACVNIVPGLTSIYRWQGSVVSDHELLLLVKTTTHAFPKLKERVKALHPYTVPEIVALPIAEGNREYLDWLRENTG

SEQ ID NO: 13 - protein, 122 aa, Artificial Sequence
  Synthetic
  MISC_FEATURE (1)..(1): optionally absent
MVRGIRGAITVEEDTPAAILAATIELLLKMLEANGIQSYEELAAVIFTVTEDLTSAFPAEAARLIGMHRVPLLSAREVPVPGSLPRVIRVLALWNTDTPQDRVRHVYLNEAVRLRPDLESAQ

SEQ ID NO: 14 - protein, 177 aa, Artificial Sequence
  Synthetic
  MISC_FEATURE (1)..(1): optionally absent
MSKAKIGIVTVSDRASAGITADISGKAIILALNLYLTSEWEPIYQVIPDEQDVIETTLIKMADEQDCCLIVTTGGTGPAKRDVTPEATEAVCDRMMPGFGELMRAESLKEVPTAILSRQTAGLRGDSLIVNLPGDPASISDCLLAVFPAIPYCIDLMEGPYLECNEAMIKPFRPKAK

SEQ ID NO: 15 - protein, 122 aa, Artificial Sequence
  Synthetic
  MISC_FEATURE (1)..(1): optionally absent
MVRGIRGAITVNSDTPTSIIIATILLLEKMLEANGIQSYEELAAVIFTVTEDLTSAFPAEAARQIGMHRVPLLSAREVPVPGSLPRVIRVLALWNTDTPQDRVRHVYLSEAVRLRPDLESAQ

SEQ ID NO: 16 - protein, 172 aa, Artificial Sequence
  Synthetic
  MISC_FEATURE (1)..(1): optionally absent
MRITTKVGDKGSTRLFGGEEVWKDSPIIEANGTLDELTSFIGEAKHYVDEEMKGILEEIQNDIYKIMGEIGSKGKIEGISEERIAWLLKLILRYMEMVNLKSFVLPGGTLESAKLDVCRTIARRALRKVLTVTREFGIGAEAAAYLLALSDLLFLLARVIEIEKNKLKEVRS

SEQ ID NO: 17 - protein, 123 aa, Artificial Sequence
  Synthetic
  MISC_FEATURE (1)..(1): optionally absent
MPHLVIEATANLRLETSPGELLEQANKALFASGQFGEADIKSRFVTLEAYRQGTAAVERAYLHACLSILDGRDIATRTLLGASLCAVLAEAVAGGGEEGVQVSVEVREMERLSYAKRVVARQR

SEQ ID NO: 18 - protein, 158 aa, Artificial Sequence
  Synthetic
  MISC_FEATURE (1)..(1): optionally absent
MESVNTSFLSPSLVTIRDFDNGQFAVLRIGRTGFPADKGDIDLCLDKMIGVRAAQIFLGDDTEDGFKGPHIRIRCVDIDDKHTYNAMVYVDLIVGTGASEVERETAEEEAKLALRVALQVDIADEHSCVTQFEMKLREELLSSDSFHPDKDEYYKDFL

SEQ ID NO: 19 - protein, 113 aa, Artificial Sequence
  Synthetic
  MISC_FEATURE (1)..(1): optionally absent
MPVIQTFVSTPLDHHKRLLLAIIYRIVTRVVLGKPEDLVMMTFHDSTPMHFFGSTDPVACVRVEALGGYGPSEPEKVTSIVTAAITAVCGIVADRIFVLYFSPLHCGWNGTNF

SEQ ID NO: 20 - protein, 113 aa, Artificial Sequence; identical to SEQ ID NO: 19
  Synthetic
  MISC_FEATURE (1)..(1): optionally absent

SEQ ID NO: 21 - protein, 205 aa, Artificial Sequence
  Synthetic
  MISC_FEATURE (1)..(1): optionally absent
MKMEELFKKHKIVAVLRANSVEEAKEKALAVFEGGVHLIEITFTVPDADTVIKELSFLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTE

SEQ ID NO: 22 - protein, 159 aa, Artificial Sequence
  Synthetic
  MISC_FEATURE (1)..(1): Xaa is any amino acid or is optionally absent
  MISC_FEATURE (2)..(3): Xaa is any amino acid
  MISC_FEATURE (4)..(4): Xaa is A, C, G, P, M, V, I, L, Selenomethionine (Sme), or Selenocysteine (Sce)
  MISC_FEATURE (5)..(5): Xaa is any amino acid
  MISC_FEATURE (6)..(7): Xaa is A, C, G, P, M, V, I, L, Sme, or Sce
  MISC_FEATURE (8)..(9): Xaa is any amino acid
  MISC_FEATURE (10)..(10): Xaa is R, H, or K
  MISC_FEATURE (11)..(13): Xaa is any amino acid
  MISC_FEATURE (14)..(15): Xaa is A, C, G, P, M, V, I, L, Sme, or Sce
  MISC_FEATURE (16)..(16): Xaa is D or E
  MISC_FEATURE (17)..(17): Xaa is any amino acid
  MISC_FEATURE (18)..(20): Xaa is A, C, G, P, M, V, I, L, Sme, or Sce
  MISC_FEATURE (21)..(21): Xaa is F, W, or Y
  MISC_FEATURE (22)..(22): Xaa is A, C, G, P, M, V, I, L, Sme, or Sce
  MISC_FEATURE (23)..(23): Xaa is any amino acid
  MISC_FEATURE (24)..(25): Xaa is A, C, G, P, M, V, I, L, Sme, or Sce
  MISC_FEATURE (26)..(26): Xaa is any amino acid
  MISC_FEATURE (27)..(27): Xaa is A, C, G, P, M, V, I, L, Sme, or Sce
  MISC_FEATURE (28)..(32): Xaa is any amino acid
  MISC_FEATURE (33)..(33): Xaa is D or E
  MISC_FEATURE (34)..(34): Xaa is A, C, G, P, M, V, I, L, Sme, or Sce
  MISC_FEATURE (35)..(35): Xaa is any amino acid
  MISC_FEATURE (36)..(36): Xaa is A, C, G, P, M, V, I, L, Sme, or Sce
  MISC_FEATURE (37)..(38): Xaa is any amino acid
  MISC_FEATURE (39)..(39): Xaa is A, C, G, P, M, V, I, L, Sme, or Sce
  MISC_FEATURE (40)..(40): Xaa is D or E
  MISC_FEATURE (41)..(41): Xaa is A, C, G, P, M, V, I, L, Sme, or Sce
  MISC_FEATURE (42)..(42): Xaa is R, H or K
  MISC_FEATURE (43)..(43): Xaa is any amino acid
  MISC_FEATURE (44)..(44): Xaa is D or E
  MISC_FEATURE (45)..(45): Xaa is A, C, G, P, M, V, I, L, Sme, or Sce
  MISC_FEATURE (46)..(46): Xaa is any amino acid
  MISC_FEATURE (47)..(47): Xaa is A, C, G, P, M, V, I, L, Sme, or Sce
  MISC_FEATURE (48)..(48): Xaa is R, H, or K
  MISC_FEATURE (49)..(50): Xaa is A, C, G, P, M, V, I, L, Sme, or Sce
  MISC_FEATURE (51)..(52): Xaa is any amino acid
  MISC_FEATURE (53)..(53): Xaa is S, T, N, or Q
  MISC_FEATURE (54)..(54): Xaa is any amino acid
  MISC_FEATURE (55)..(55): Xaa is S, T, N, or Q
  MISC_FEATURE (56)..(56): Xaa is A, C, G, P, M, V, I, L, Sme, or Sce
  MISC_FEATURE (57)..(57): Xaa is F, W, or Y
  MISC_FEATURE (58)..(60): Xaa is any amino acid
  MISC_FEATURE (61)..(62): Xaa is F, W, or Y
  MISC_FEATURE (63)..(66): Xaa is any amino acid
  MISC_FEATURE (66)..(66): Xaa is A, C, G, P, M, V, I, L, Sme, or Sce
  MISC_FEATURE (67)..(67): Xaa is S, T, N, or Q
  MISC_FEATURE (68)..(68): Xaa is A, C, G, P, M, V, I, L, Sme, or Sce
  MISC_FEATURE (84)..(84): Xaa is any amino acid
  MISC_FEATURE (85)..(86): Xaa is A, C, G, P, M, V, I, L, Sme, or Sce
  MISC_FEATURE (87)..(87): Xaa is any amino acid
  MISC_FEATURE (88)..(90): Xaa is A, C, G, P, M, V, I, L, Sme, or Sce
  MISC_FEATURE (91)..(92): Xaa is any amino acid
  MISC_FEATURE (93)..(93): Xaa is A, C, G, P, M, V, I, L, Sme, or Sce
  MISC_FEATURE (94)..(94): Xaa is any amino acid
  MISC_FEATURE (95)..(95): Xaa is R, H, or K
  MISC_FEATURE (96)..(96): Xaa is F, W, or Y
  MISC_FEATURE (97)..(98): Xaa is A, C, G, P, M, V, I, L, Sme, or Sce
  MISC_FEATURE (99)..(99): Xaa is S, T, N, or Q
  MISC_FEATURE (100)..(102): Xaa is A, C, G, P, M, V, I, L, Sme, or Sce
  MISC_FEATURE (103)..(104): Xaa is any amino acid
  MISC_FEATURE (105)..(105): Xaa is D or E
  MISC_FEATURE (106)..(107): Xaa is any amino acid
  MISC_FEATURE (108)..(109): Xaa is A, C, G, P, M, V, I, L, Sme, or Sce
  MISC_FEATURE (110)..(110): Xaa is F, W, or Y
  MISC_FEATURE (111)..(111): Xaa is A, C, G, P, M, V, I, L, Sme, or Sce
  MISC_FEATURE (112)..(112): Xaa is any amino acid
  MISC_FEATURE (113)..(113): Xaa is A, C, G, P, M, V, I, L, Sme, or Sce
  MISC_FEATURE (122)..(123): Xaa is S, T, N, or Q
  MISC_FEATURE (124)..(124): Xaa is A, C, G, P, M, V, I, L, Sme, or Sce
  MISC_FEATURE (125)..(125): Xaa is D or E
  MISC_FEATURE (126)..(127): Xaa is any amino acid
  MISC_FEATURE (128)..(128): Xaa is A, C, G, P, M, V, I, L, Sme, or Sce
  MISC_FEATURE (129)..(129): Xaa is F, W, or Y
  MISC_FEATURE (130)..(130): Xaa is A, C, G, P, M, V, I, L, Sme, or Sce
  MISC_FEATURE (131)..(132): Xaa is R, H, or K
  MISC_FEATURE (133)..(133): Xaa is any amino acid
  MISC_FEATURE (134)..(134): Xaa is D or E
  MISC_FEATURE (135)..(136): Xaa is any amino acid
  MISC_FEATURE (137)..(137): Xaa is S, T, N, or Q
  MISC_FEATURE (138)..(140): Xaa is A, C, G, P, M, V, I, L, Sme, or Sce
  MISC_FEATURE (141)..(142): Xaa is any amino acid
  MISC_FEATURE (143)..(143): Xaa is F, W, or Y
  MISC_FEATURE (144)..(144): Xaa is any amino acid
  MISC_FEATURE (153)..(153): Xaa is any amino acid
  MISC_FEATURE (154)..(154): Xaa is F, W, or Y
  MISC_FEATURE (155)..(155): Xaa is any amino acid
  MISC_FEATURE (156)..(156): Xaa is A, C, G, P, M, V, I, L, Sme, or Sce
  MISC_FEATURE (157)..(159): Xaa is any amino acid
XXXXXXXXXXXXXXXXXXXXXXXXXXXXXXXXXXXXXXXXXXXXXXXXXXXXXXXXXXXXXXXXXXXXAYALANADTGAIKTGXXXXXXXXXXXXXXXXXXXXXXXXXXXXXXTYALTFLIXXXXXXXXXXXXXXXXXXXXXXXPFVVTYFFXXXXXXX

SEQ ID NO: 23 - protein, 184 aa, Artificial Sequence
  Synthetic
  MISC_FEATURE (1)..(1): Xaa is any amino acid or optionally absent
  MISC_FEATURE (2)..(2): Xaa is any amino acid
  MISC_FEATURE (3)..(3): Xaa is S, T, N, or Q
  MISC_FEATURE (4)..(8): Xaa is A, C, G, P, M, V, I, L, Selenomethionine (Sme), or Selenocysteine (Sce)
  MISC_FEATURE (9)..(9): Xaa is D or E
  MISC_FEATURE (10)..(10): Xaa is A, C, G, P, M, V, I, L, Sce or Sme
  MISC_FEATURE (11)..(11): Xaa is any amino acid
  MISC_FEATURE (12)..(12): Xaa is S, T, N, or Q
  MISC_FEATURE (13)..(14): Xaa is A, C, G, P, M, V, I, L, Sce or Sme
  MISC_FEATURE (15)..(15): Xaa is R, H, or K
  MISC_FEATURE (16)..(16): Xaa is A, C, G, P, M, V, I, L, Sce or Sme
  MISC_FEATURE (17)..(17): Xaa is any amino acid
  MISC_FEATURE (18)..(18): Xaa is D or E
  MISC_FEATURE (19)..(20): Xaa is A, C, G, P, M, V, I, L, Sce or Sme
  MISC_FEATURE (21)..(21): Xaa is D or E
  MISC_FEATURE (22)..(22): Xaa is any amino acid
  MISC_FEATURE (23)..(24): Xaa is A, C, G, P, M, V, I, L, Sce or Sme
  MISC_FEATURE (25)..(26): Xaa is any amino acid
  MISC_FEATURE (27)..(27): Xaa is A, C, G, P, M, V, I, L, Sce or Sme
  MISC_FEATURE (28)..(28): Xaa is any amino acid
  MISC_FEATURE (29)..(29): Xaa is A, C, G, P, M, V, I, L, Sce or Sme
  MISC_FEATURE (30)..(31): Xaa is any amino acid
  MISC_FEATURE (32)..(33): Xaa is A, C, G, P, M, V, I, L, Sce or Sme
  MISC_FEATURE (34)..(36): Xaa is any amino acid
  MISC_FEATURE (35)..(35): Xaa is R, H, or K
  MISC_FEATURE (37)..(37): Xaa is A, C, G, P, M, V, I, L, Sce or Sme
  MISC_FEATURE (38)..(39): Xaa is any amino acid
  MISC_FEATURE (40)..(40): Xaa is A, C, G, P, M, V, I, L, Sce or Sme
  MISC_FEATURE (41)..(41): Xaa is R, H, or K
  MISC_FEATURE (42)..(42): Xaa is F, W, or Y
  MISC_FEATURE (43)..(48): Xaa is A, C, G, P, M, V, I, L, Sce or Sme
  MISC_FEATURE (49)..(51): Xaa is any amino acid
  MISC_FEATURE (52)..(53): Xaa is A, C, G, P, M, V, I, L, Sce or Sme
  MISC_FEATURE (54)..(55): Xaa is any amino acid
  MISC_FEATURE (56)..(57): Xaa is A, C, G, P, M, V, I, L, Sce or Sme
  MISC_FEATURE (58)..(58): Xaa is any amino acid
  MISC_FEATURE (59)..(59): Xaa is S, T, N, or Q
  MISC_FEATURE (60)..(60): Xaa is A, C, G, P, M, V, I, L, Sce or Sme
  MISC_FEATURE (61)..(63): Xaa is any amino acid
  MISC_FEATURE (64)..(64): Xaa is A, C, G, P, M, V, I, L, Sce or Sme
  MISC_FEATURE (65)..(66): Xaa is any amino acid
  MISC_FEATURE (67)..(67): Xaa is A, C, G, P, M, V, I, L, Sce or Sme
  MISC_FEATURE (68)..(73): Xaa is any amino acid
  MISC_FEATURE (74)..(74): Xaa is A, C, G, P, M, V, I, L, Sce or Sme
  MISC_FEATURE (75)..(76): Xaa is any amino acid
  MISC_FEATURE (77)..(77): Xaa is A, C, G, P, M, V, I, L, Sce or Sme
  MISC_FEATURE (78)..(78): Xaa is R, H, or K
  MISC_FEATURE (79)..(79): Xaa is any amino acid
  MISC_FEATURE (80)..(80): Xaa is S, T, N, or Q
  MISC_FEATURE (81)..(81): Xaa is A, C, G, P, M, V, I, L, Sce or Sme
  MISC_FEATURE (82)..(83): Xaa is any amino acid
  MISC_FEATURE (84)..(84): Xaa is A, C, G, P, M, V, I, L, Sce or Sme
  MISC_FEATURE (85)..(86): Xaa is any amino acid
  MISC_FEATURE (87)..(87): Xaa is A, C, G, P, M, V, I, L, Sce or Sme
  MISC_FEATURE (88)..(95): Xaa is any amino acid
  MISC_FEATURE (97)..(97): Xaa is A, C, G, P, M, V, I, L, Sce or Sme
  MISC_FEATURE (98)..(98): Xaa is S, T, N, or Q
  MISC_FEATURE (99)..(100): Xaa is A, C, G, P, M, V, I, L, Sce or Sme
  MISC_FEATURE (101)..(101): Xaa is D or E
  MISC_FEATURE (102)..(102): Xaa is S, T, N, or Q
  MISC_FEATURE (103)..(103): Xaa is F, W, or Y
  MISC_FEATURE (104)..(104): Xaa is S, T, N, or Q
  MISC_FEATURE (105)..(105): Xaa is A, C, G, P, M, V, I, L, Sce or Sme
  MISC_FEATURE (106)..(106): Xaa is any amino acid
  MISC_FEATURE (107)..(108): Xaa is A, C, G, P, M, V, I, L, Sce or Sme
  MISC_FEATURE (109)..(110): Xaa is any amino acid
  MISC_FEATURE (111)..(112): Xaa is A, C, G, P, M, V, I, L, Sce or Sme
  MISC_FEATURE (112)..(112): Xaa is any amino acid
  MISC_FEATURE (113)..(113): Xaa is D or E
  MISC_FEATURE (116)..(116): Xaa is A, C, G, P, M, V, I, L, Sce or Sme
  MISC_FEATURE (121)..(121): Xaa is A, C, G, P, M, V, I, L, Sce or Sme
  MISC_FEATURE (122)..(122): Xaa is any amino acid
  MISC_FEATURE (123)..(124): Xaa is A, C, G, P, M, V, I, L, Sce or Sme
  MISC_FEATURE (125)..(125): Xaa is R, H, or K
  MISC_FEATURE (126)..(126): Xaa is A, C, G, P, M, V, I, L, Sce or Sme
  MISC_FEATURE (127)..(130): Xaa is any amino acid
  MISC_FEATURE (131)..(131): Xaa is A, C, G, P, M, V, I, L, Sce or Sme
  MISC_FEATURE (132)..(133): Xaa is any amino acid
  MISC_FEATURE (134)..(134): Xaa is A, C, G, P, M, V, I, L, Sce or Sme
  MISC_FEATURE (135)..(135): Xaa is R, H, or K
  MISC_FEATURE (136)..(136): Xaa is A, C, G, P, M, V, I, L, Sce or Sme
  MISC_FEATURE (137)..(137): Xaa is F, W, or Y
  MISC_FEATURE (138)..(142): Xaa is A, C, G, P, M, V, I, L, Sce or Sme
  MISC_FEATURE (158)..(158): Xaa is A, C, G, P, M, V, I, L, Sce or Sme
  MISC_FEATURE (161)..(162): Xaa is any amino acid
  MISC_FEATURE (163)..(163): Xaa is A, C, G, P, M, V, I, L, Sce or Sme
  MISC_FEATURE (164)..(165): Xaa is any amino acid
  MISC_FEATURE (166)..(166): Xaa is F, W, or Y
  MISC_FEATURE (173)..(173): Xaa is A, C, G, P, M, V, I, L, Sce or Sme
  MISC_FEATURE (174)..(174): Xaa is R, H, or K
  MISC_FEATURE (175)..(176): Xaa is any amino acid
  MISC_FEATURE (177)..(177): Xaa is A, C, G, P, M, V, I, L, Sce or Sme
  MISC_FEATURE (178)..(178): Xaa is F, W, or Y
  MISC_FEATURE (179)..(184): Xaa is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXLAXKGSNXXXXXXXXXXXXXXXXXXXXXXDVLDVAAAVATASLAXGAXXXXXXASIIPRXXXXXXXXXXXX

SEQ ID NO: 24 - protein, 103 aa, Artificial Sequence
  Synthetic
  MISC_FEATURE (1)..(1): Xaa is any amino acid or optionally absent
  MISC_FEATURE (2)..(3): Xaa is D or E
  MISC_FEATURE (4)..(7): Xaa is A, C, G, P, M, V, I, L, Selenomethionine (Sme), or Selenocysteine (Sce)
  MISC_FEATURE (8)..(8): Xaa is S, T, N, or Q
  MISC_FEATURE (9)..(10): Xaa is A, C, G, P, M, V, I, L, Sce or Sme
  MISC_FEATURE (11)..(11): Xaa is S, T, N, or Q
  MISC_FEATURE (18)..(19): Xaa is A, C, G, P, M, V, I, L, Sce or Sme
  MISC_FEATURE (21)..(23): Xaa is A, C, G, P, M, V, I, L, Sce or Sme
  MISC_FEATURE (24)..(26): Xaa is any amino acid
  MISC_FEATURE (27)..(31): Xaa is A, C, G, P, M, V, I, L, Sce or Sme
  MISC_FEATURE (32)..(32): Xaa is S, T, N, or Q
  MISC_FEATURE (34)..(34): Xaa is A, C, G, P, M, V, I, L, Sce or Sme
  MISC_FEATURE (39)..(39): Xaa is S, T, N, or Q
  MISC_FEATURE (41)..(41): Xaa is any amino acid
  MISC_FEATURE (42)..(42): Xaa is R, H or K
  MISC_FEATURE (44)..(45): Xaa is any amino acid
  MISC_FEATURE (50)..(50): Xaa is D or E
  MISC_FEATURE (52)..(52): Xaa is D or E
  MISC_FEATURE (54)..(57): Xaa is A, C, G, P, M, V, I, L, Sce or Sme
  MISC_FEATURE (58)..(58): Xaa is R, H or K
  MISC_FEATURE (59)..(60): Xaa is S, T, N, or Q
  MISC_FEATURE (61)..(62): Xaa is any amino acid
  MISC_FEATURE (63)..(63): Xaa is A, C, G, P, M, V, I, L, Sce or Sme
  MISC_FEATURE (64)..(64): Xaa is F, W, or Y
  MISC_FEATURE (65)..(66): Xaa is any amino acid
  MISC_FEATURE (67)..(67): Xaa is A, C, G, P, M, V, I, L, Sce or Sme
  MISC_FEATURE (68)..(68): Xaa is R, H or K
  MISC_FEATURE (69)..(70): Xaa is any amino acid
  MISC_FEATURE (71)..(71): Xaa is A, C, G, P, M, V, I, L, Sce or Sme
  MISC_FEATURE (72)..(73): Xaa is any amino acid
  MISC_FEATURE (74)..(74): Xaa is A, C, G, P, M, V, I, L, Sce or Sme
  MISC_FEATURE (75)..(75): Xaa is R, H or K
  MISC_FEATURE (76)..(79): Xaa is any amino acid
  MISC_FEATURE (80)..(80): Xaa is A, C, G, P, M, V, I, L, Sce or Sme
  MISC_FEATURE (81)..(81): Xaa is D or E
  MISC_FEATURE (82)..(87): Xaa is A, C, G, P, M, V, I, L, Sce or Sme
  MISC_FEATURE (88)..(89): Xaa is any amino acid
  MISC_FEATURE (90)..(90): Xaa is A, C, G, P, M, V, I, L, Sce or Sme
  MISC_FEATURE (91)..(91): Xaa is S, T, N, or Q
  MISC_FEATURE (92)..(93): Xaa is any amino acid
  MISC_FEATURE (94)..(94): Xaa is F, W, or Y
  MISC_FEATURE (95)..(95): Xaa is A, C, G, P, M, V, I, L, Sce or Sme
  MISC_FEATURE (96)..(96): Xaa is any amino acid
  MISC_FEATURE (97)..(97): Xaa is F, W, or Y
  MISC_FEATURE (98)..(98): Xaa is A, C, G, P, M, V, I, L, Sce or Sme
  MISC_FEATURE (99)..(100): Xaa is any amino acid
  MISC_FEATURE (101)..(102): Xaa is S, T, N, or Q
  MISC_FEATURE (103)..(103): Xaa is A, C, G, P, M, V, I, L, Sce or Sme
XXXXXXXXXXXALVAVKXXHXXXXXXXXXXXXIXPGLTXIXXWXXSVVSXHXLXXXXXXXXXXXXXXXXXXXXXXXXXXXXXXXXXXXXXXXXXXXXXXXXXX

SEQ ID NO: 25 - protein, 122 aa, Artificial Sequence
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(5): Xaa is A, C, G, P, M, V, I, L, Sce, or Sme
  MISC_FEATURE (6)..(6): Xaa is R, H, or K
  MISC_FEATURE (7)..(8): Xaa is A, C, G, P, M, V, I, L, Sce, or Sme
  MISC_FEATURE (10)..(10): Xaa is S, T, N, or Q
  MISC_FEATURE (11)..(11): Xaa is A, C, G, P, M, V, I, L, Sce, or Sme
  MISC_FEATURE (14)..(14): Xaa is any amino acid
  MISC_FEATURE (19)..(19): Xaa is A, C, G, P, M, V, I, L, Sce, or Sme
  MISC_FEATURE (23)..(23): Xaa is S, T, N, or Q
  MISC_FEATURE (26)..(27): Xaa is A, C, G, P, M, V, I, L, Sce, or Sme
  MISC_FEATURE (30)..(31): Xaa is A, C, G, P, M, V, I, L, Sce, or Sme
  MISC_FEATURE (33)..(33): Xaa is A, C, G, P, M, V, I, L, Sce, or Sme
  MISC_FEATURE (34)..(34): Xaa is S, T, N, or Q
  MISC_FEATURE (35)..(35): Xaa is any amino acid
  MISC_FEATURE (36)..(36): Xaa is A, C, G, P, M, V, I, L, Sce, or Sme
  MISC_FEATURE (37)..(37): Xaa is any amino acid
  MISC_FEATURE (38)..(38): Xaa is S, T, N, or Q
  MISC_FEATURE (39)..(40): Xaa is any amino acid
  MISC_FEATURE (41)..(41): Xaa is D or E
  MISC_FEATURE (42)..(46): Xaa is A, C, G, P, M, V, I, L, Sce, or Sme
  MISC_FEATURE (47)..(122): Xaa is F, W, or Y
  MISC_FEATURE (48)..(48): Xaa is S, T, N, or Q
  MISC_FEATURE (49)..(49): Xaa is A, C, G, P, M, V, I, L, Sce, or Sme
  MISC_FEATURE (50)..(50): Xaa is S, T, N, or Q
  MISC_FEATURE (51)..(52): Xaa is any amino acid
  MISC_FEATURE (53)..(53): Xaa is A, C, G, P, M, V, I, L, Sce, or Sme
  MISC_FEATURE (54)..(55): Xaa is S, T, N, or Q
  MISC_FEATURE (56)..(56): Xaa is A, C, G, P, M, V, I, L, Sce, or Sme
  MISC_FEATURE (57)..(57): Xaa is F, W, or Y
  MISC_FEATURE (58)..(59): Xaa is A, C, G, P, M, V, I, L, Sce, or Sme
  MISC_FEATURE (62)..(62): Xaa is A, C, G, P, M, V, I, L, Sce, or Sme
  MISC_FEATURE (63)..(63): Xaa is R, H, or K
  MISC_FEATURE (66)..(67): Xaa is A, C, G, P, M, V, I, L, Sce, or Sme
  MISC_FEATURE (69)..(69): Xaa is any amino acid
  MISC_FEATURE (70)..(73): Xaa is A, C, G, P, M, V, I, L, Sce, or Sme
  MISC_FEATURE (74)..(74): Xaa is S, T, N, or Q
  MISC_FEATURE (75)..(75): Xaa is A, C, G, P, M, V, I, L, Sce, or Sme
  MISC_FEATURE (76)..(76): Xaa is R, H, or K
  MISC_FEATURE (77)..(77): Xaa is D or E
  MISC_FEATURE (78)..(78): Xaa is A, C, G, P, M, V, I, L, Sce, or Sme
  MISC_FEATURE (79)..(79): Xaa is any amino acid
  MISC_FEATURE (80)..(80): Xaa is A, C, G, P, M, V, I, L, Sce, or Sme
  MISC_FEATURE (81)..(82): Xaa is any amino acid
  MISC_FEATURE (83)..(83): Xaa is S, T, N, or Q
  MISC_FEATURE (84)..(84): Xaa is A, C, G, P, M, V, I, L, Sce, or Sme
  MISC_FEATURE (85)..(86): Xaa is any amino acid
  MISC_FEATURE (87)..(88): Xaa is A, C, G, P, M, V, I, L, Sce, or Sme
  MISC_FEATURE (89)..(89): Xaa is R, H, or K
  MISC_FEATURE (90)..(93): Xaa is A, C, G, P, M, V, I, L, Sce, or Sme
  MISC_FEATURE (94)..(94): Xaa is F, W, or Y
  MISC_FEATURE (95)..(96): Xaa is S, T, N, or Q
  MISC_FEATURE (97)..(97): Xaa is any amino acid
  MISC_FEATURE (98)..(98): Xaa is S, T, N, or Q
  MISC_FEATURE (99)..(99): Xaa is any amino acid
  MISC_FEATURE (100)..(100): Xaa is S, T, N, or Q
  MISC_FEATURE (101)..(102): Xaa is any amino acid
  MISC_FEATURE (103)..(103): Xaa is A, C, G, P, M, V, I, L, Sce, or Sme
  MISC_FEATURE (104)..(104): Xaa is any amino acid
  MISC_FEATURE (105)..(105): Xaa is R, H, or K
  MISC_FEATURE (106)..(106): Xaa is A, C, G, P, M, V, I, L, Sce, or Sme
  MISC_FEATURE (107)..(107): Xaa is F, W, or Y
  MISC_FEATURE (108)..(108): Xaa is A, C, G, P, M, V, I, L, Sce, or Sme
  MISC_FEATURE (110)..(110): Xaa is any amino acid
  MISC_FEATURE (111)..(111): Xaa is A, C, G, P, M, V, I, L, Sce, or Sme
  MISC_FEATURE (112)..(113): Xaa is any amino acid
  MISC_FEATURE (114)..(114): Xaa is A, C, G, P, M, V, I, L, Sce, or Sme
  MISC_FEATURE (115)..(115): Xaa is R, H, or K
  MISC_FEATURE (116)..(122): Xaa is any amino acid
XXXXXXXXIXXEEXTPAAXLAAXIEXXLKXXEXXXXXXXXXXXXXXXXXXXXXXXXXXXEAXXLIXXHXXXXXXXXXXXXXXXXXXXXXXXXXXXXXXXXXXXXXXXXNXXXXXXXXXXXXX

SEQ ID NO: 26 - protein, 177 aa, Artificial Sequence
  Synthetic
  MISC_FEATURE (1)..(1): Xaa is any amino acid or is optionally absent
  MISC_FEATURE (2)..(3): Xaa is any amino acid
  MISC_FEATURE (4)..(4): Xaa is A, C, G, P, M, V, I, L, Selenomethionine (Sme), or Selenocysteine (Sce)
  MISC_FEATURE (5)..(5): Xaa is R, H, or K
  MISC_FEATURE (6)..(9): Xaa is A, C, G, P, M, V, I, L, Sce or Sme
  MISC_FEATURE (10)..(10): Xaa is S, T, N or Q
  MISC_FEATURE (11)..(11): Xaa is A, C, G, P, M, V, I, L, Sce or Sme
  MISC_FEATURE (12)..(12): Xaa is S, T, N or Q
  MISC_FEATURE (13)..(13): Xaa is D or E
  MISC_FEATURE (14)..(14): Xaa is R, H, or K
  MISC_FEATURE (15)..(15): Xaa is A, C, G, P, M, V, I, L, Sce or Sme
  MISC_FEATURE (16)..(21): Xaa is any amino acid
  MISC_FEATURE (22)..(22): Xaa is D or E
  MISC_FEATURE (24)..(24): Xaa is S, T, N or Q
  MISC_FEATURE (25)..(25): Xaa is A, C, G, P, M, V, I, L, Sce or Sme
  MISC_FEATURE (28)..(29): Xaa is A, C, G, P, M, V, I, L, Sce or Sme
  MISC_FEATURE (32)..(32): Xaa is A, C, G, P, M, V, I, L, Sce or Sme
  MISC_FEATURE (36)..(36): Xaa is A, C, G, P, M, V, I, L, Sce or Sme
  MISC_FEATURE (37)..(37): Xaa is any amino acid
  MISC_FEATURE (38)..(38): Xaa is S, T, N or Q
  MISC_FEATURE (39)..(39): Xaa is any amino acid
  MISC_FEATURE (40)..(40): Xaa is F, W, or Y
  MISC_FEATURE (41)..(41): Xaa is D or E
  MISC_FEATURE (42)..(42): Xaa is any amino acid
  MISC_FEATURE (43)..(43): Xaa is A, C, G, P, M, V, I, L, Sce or Sme
  MISC_FEATURE (44)..(45): Xaa is any amino acid
  MISC_FEATURE (46)..(48): Xaa is A, C, G, P, M, V, I, L, Sce or Sme
  MISC_FEATURE (49)..(50): Xaa is D or E
  MISC_FEATURE (51)..(53): Xaa is any amino acid
  MISC_FEATURE (54)..(54): Xaa is A, C, G, P, M, V, I, L, Sce or Sme
  MISC_FEATURE (55)..(55): Xaa is D or E
  MISC_FEATURE (56)..(56): Xaa is any amino acid
  MISC_FEATURE (57)..(57): Xaa is S, T, N or Q
  MISC_FEATURE (58)..(58): Xaa is A, C, G, P, M, V, I, L, Sce or Sme
  MISC_FEATURE (59)..(59): Xaa is any amino acid
  MISC_FEATURE (60)..(60): Xaa is R, H, or K
  MISC_FEATURE (61)..(62): Xaa is A, C, G, P, M, V, I, L, Sce or Sme
  MISC_FEATURE (63)..(66): Xaa is any amino acid
  MISC_FEATURE (67)..(71): Xaa is A, C, G, P, M, V, I, L, Sce or Sme
  MISC_FEATURE (72)..(73): Xaa is S, T, N or Q
  MISC_FEATURE (74)..(75): Xaa is A, C, G, P, M, V, I, L, Sce or Sme
  MISC_FEATURE (76)..(76): Xaa is S, T, N or Q
  MISC_FEATURE (77)..(79): Xaa is A, C, G, P, M, V, I, L, Sce or Sme
  MISC_FEATURE (80)..(81): Xaa is any amino acid
  MISC_FEATURE (82)..(82): Xaa is D or E
  MISC_FEATURE (83)..(83): Xaa is A, C, G, P, M, V, I, L, Sce or Sme
  MISC_FEATURE (84)..(84): Xaa is S, T, N or Q
  MISC_FEATURE (85)..(85): Xaa is A, C, G, P, M, V, I, L, Sce or Sme
  MISC_FEATURE (86)..(86): Xaa is D or E
  MISC_FEATURE (87)..(87): Xaa is A, C, G, P, M, V, I, L, Sce or Sme
  MISC_FEATURE (88)..(88): Xaa is S, T, N or Q
  MISC_FEATURE (89)..(90): Xaa is any amino acid
  MISC_FEATURE (91)..(92): Xaa is A, C, G, P, M, V, I, L, Sce or Sme
  MISC_FEATURE (93)..(93): Xaa is any amino acid
  MISC_FEATURE (94)..(94): Xaa is R, H, or K
  MISC_FEATURE (95)..(95): Xaa is any amino acid
  MISC_FEATURE (96)..(98): Xaa is A, C, G, P, M, V, I, L, Sce or Sme
  MISC_FEATURE (99)..(99): Xaa is F, W, or Y
  MISC_FEATURE (100)..(100): Xaa is A, C, G, P, M, V, I, L, Sce or Sme
  MISC_FEATURE (101)..(101): Xaa is D or E
  MISC_FEATURE (102)..(103): Xaa is A, C, G, P, M, V, I, L, Sce or Sme
  MISC_FEATURE (104)..(104): Xaa is R, H, or K
  MISC_FEATURE (105)..(106): Xaa is any amino acid
  MISC_FEATURE (107)..(107): Xaa is S, T, N or Q
  MISC_FEATURE (108)..(110): Xaa is any amino acid
  MISC_FEATURE (111)..(112): Xaa is A, C, G, P, M, V, I, L, Sce or Sme
  MISC_FEATURE (113)..(113): Xaa is S, T, N or Q
  MISC_FEATURE (114)..(116): Xaa is A, C, G, P, M, V, I, L, Sce or Sme
  MISC_FEATURE (117)..(117): Xaa is S, T, N or Q
  MISC_FEATURE (118)..(118): Xaa is R, H, or K
  MISC_FEATURE (119)..(120): Xaa is S, T, N or Q
  MISC_FEATURE (121)..(123): Xaa is A, C, G, P, M, V, I, L, Sce or Sme
  MISC_FEATURE (124)..(124): Xaa is any amino acid
  MISC_FEATURE (125)..(125): Xaa is A, C, G, P, M, V, I, L, Sce or Sme
  MISC_FEATURE (126)..(126): Xaa is any amino acid
  MISC_FEATURE (127)..(127): Xaa is S, T, N or Q
  MISC_FEATURE (128)..(130): Xaa is A, C, G, P, M, V, I, L, Sce or Sme
  MISC_FEATURE (131)..(131): Xaa is S, T, N or Q
  MISC_FEATURE (132)..(134): Xaa is A, C, G, P, M, V, I, L, Sce or Sme
  MISC_FEATURE (135)..(135): Xaa is any amino acid
  MISC_FEATURE (136)..(136): Xaa is A, C, G, P, M, V, I, L, Sce or Sme
  MISC_FEATURE (139)..(139): Xaa is A, C, G, P, M, V, I, L, Sce or Sme
  MISC_FEATURE (142)..(143): Xaa is A, C, G, P, M, V, I, L, Sce or Sme
  MISC_FEATURE (145)..(146): Xaa is A, C, G, P, M, V, I, L, Sce or Sme
  MISC_FEATURE (147)..(147): Xaa is F, W, or Y
  MISC_FEATURE (148)..(151): Xaa is A, C, G, P, M, V, I, L, Sce or Sme
  MISC_FEATURE (152)..(152): Xaa is any amino acid
  MISC_FEATURE (153)..(154): Xaa is A, C, G, P, M, V, I, L, Sce or Sme
  MISC_FEATURE (155)..(155): Xaa is D or E
  MISC_FEATURE (156)..(156): Xaa is any amino acid
  MISC_FEATURE (157)..(157): Xaa is A, C, G, P, M, V, I, L, Sce or Sme
  MISC_FEATURE (158)..(158): Xaa is any amino acid
  MISC_FEATURE (159)..(160): Xaa is A, C, G, P, M, V, I, L, Sce or Sme
  MISC_FEATURE (161)..(161): Xaa is any amino acid
  MISC_FEATURE (162)..(162): Xaa is A, C, G, P, M, V, I, L, Sce or Sme
  MISC_FEATURE (163)..(163): Xaa is D or E
  MISC_FEATURE (164)..(164): Xaa is A, C, G, P, M, V, I, L, Sce or Sme
  MISC_FEATURE (165)..(166): Xaa is any amino acid
  MISC_FEATURE (169)..(169): Xaa is A, C, G, P, M, V, I, L, Sce or Sme
  MISC_FEATURE (170)..(170): Xaa is any amino acid
  MISC_FEATURE (171)..(171): Xaa is A, C, G, P, M, V, I, L, Sce or Sme
  MISC_FEATURE (172)..(172): Xaa is F, W, or Y
  MISC_FEATURE (173)..(177): Xaa is any amino acid
XXXXXXXXXXXXXXXXXXXXXXIXXKAXXLAXNLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASXSDXXLXXXXXXXXXXXXXXXXXXXXXXAMXXXXXXXXX

SEQ ID NO: 27 - protein, 122 aa, Artificial Sequence
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(5): Xaa is A, C, G, P, M, V, I, L, Sce, or Sme
  MISC_FEATURE (6)..(6): Xaa is R, H, or K
  MISC_FEATURE (7)..(9): Xaa is A, C, G, P, M, V, I, L, Sce, or Sme
  MISC_FEATURE (10)..(10): Xaa is S, T, N, or Q
  MISC_FEATURE (11)..(11): Xaa is A, C, G, P, M, V, I, L, Sce, or Sme
  MISC_FEATURE (14)..(14): Xaa is any amino acid
  MISC_FEATURE (19)..(19): Xaa is A, C, G, P, M, V, I, L, Sce, or Sme
  MISC_FEATURE (22)..(22): Xaa is A, C, G, P, M, V, I, L, Sce, or Sme
  MISC_FEATURE (23)..(23): Xaa is S, T, N, or Q
  MISC_FEATURE (26)..(27): Xaa is A, C, G, P, M, V, I, L, Sce, or Sme
  MISC_FEATURE (29)..(29): Xaa is R, H, or K
  MISC_FEATURE (30)..(31): Xaa is A, C, G, P, M, V, I, L, Sce, or Sme
  MISC_FEATURE (32)..(33): Xaa is any amino acid
  MISC_FEATURE (34)..(34): Xaa is S, T, N, or Q
  MISC_FEATURE (35)..(35): Xaa is any amino acid
  MISC_FEATURE (36)..(36): Xaa is A, C, G, P, M, V, I, L, Sce, or Sme
  MISC_FEATURE (37)..(37): Xaa is any amino acid
  MISC_FEATURE (38)..(38): Xaa is S, T, N, or Q
  MISC_FEATURE (39)..(39): Xaa is any amino acid
  MISC_FEATURE (40)..(40): Xaa is D or E
  MISC_FEATURE (41)..(41): Xaa is any amino acid
  MISC_FEATURE (42)..(46): Xaa is A, C, G, P, M, V, I, L, Sce, or Sme
  MISC_FEATURE (47)..(47): Xaa is F, W, or Y
  MISC_FEATURE (48)..(48): Xaa is S, T, N, or Q
  MISC_FEATURE (49)..(49): Xaa is A, C, G, P, M, V, I, L, Sce, or Sme
  MISC_FEATURE (50)..(50): Xaa is S, T, N, or Q
  MISC_FEATURE (51)..(52): Xaa is any amino acid
  MISC_FEATURE (53)..(53): Xaa is A, C, G, P, M, V, I, L, Sce, or Sme
  MISC_FEATURE (54)..(55): Xaa is S, T, N, or Q
  MISC_FEATURE (56)..(56): Xaa is A, C, G, P, M, V, I, L, Sce, or Sme
  MISC_FEATURE (57)..(57): Xaa is any amino acid
  MISC_FEATURE (58)..(59): Xaa is A, C, G, P, M, V, I, L, Sce, or Sme
  MISC_FEATURE (60)..(60): Xaa is D or E
  MISC_FEATURE (61)..(62): Xaa is A, C, G, P, M, V, I, L, Sce, or Sme
  MISC_FEATURE (63)..(63): Xaa is R, H, or K
  MISC_FEATURE (65)..(67): Xaa is A, C, G, P, M, V, I, L, Sce, or Sme
  MISC_FEATURE (68)..(68): Xaa is any amino acid
  MISC_FEATURE (69)..(69): Xaa is R, H, or K
  MISC_FEATURE (70)..(73): Xaa is A, C, G, P, M, V, I, L, Sce, or Sme
  MISC_FEATURE (74)..(74): Xaa is S, T, N, or Q
  MISC_FEATURE (75)..(75): Xaa is A, C, G, P, M, V, I, L, Sce, or Sme
  MISC_FEATURE (76)..(76): Xaa is R, H, or K
  MISC_FEATURE (77)..(77): Xaa is D or E
  MISC_FEATURE (78)..(78): Xaa is A, C, G, P, M, V, I, L, Sce, or Sme
  MISC_FEATURE (79)..(79): Xaa is any amino acid
  MISC_FEATURE (80)..(80): Xaa is A, C, G, P, M, V, I, L, Sce, or Sme
  MISC_FEATURE (81)..(82): Xaa is any amino acid
  MISC_FEATURE (83)..(83): Xaa is S, T, N, or Q
  MISC_FEATURE (84)..(84): Xaa is A, C, G, P, M, V, I, L, Sce, or Sme
  MISC_FEATURE (85)..(86): Xaa is any amino acid
  MISC_FEATURE (87)..(88): Xaa is A, C, G, P, M, V, I, L, Sce, or Sme
  MISC_FEATURE (89)..(89): Xaa is R, H, or K
  MISC_FEATURE (90)..(93): Xaa is A, C, G, P, M, V, I, L, Sce, or Sme
  MISC_FEATURE (94)..(94): Xaa is F, W, or Y
  MISC_FEATURE (95)..(96): Xaa is S, T, N, or Q
  MISC_FEATURE (97)..(97): Xaa is any amino acid
  MISC_FEATURE (98)..(98): Xaa is S, T, N, or Q
  MISC_FEATURE (99)..(99): Xaa is any amino acid
  MISC_FEATURE (100)..(100): Xaa is S, T, N, or Q
  MISC_FEATURE (101)..(102): Xaa is any amino acid
  MISC_FEATURE (103)..(103): Xaa is A, C, G, P, M, V, I, L, Sce, or Sme
  MISC_FEATURE (104)..(105): Xaa is any amino acid
  MISC_FEATURE (106)..(106): Xaa is A, C, G, P, M, V, I, L, Sce, or Sme
  MISC_FEATURE (107)..(107): Xaa is any amino acid
  MISC_FEATURE (108)..(108): Xaa is A, C, G, P, M, V, I, L, Sce, or Sme
  MISC_FEATURE (110)..(110): Xaa is D or E
  MISC_FEATURE (111)..(111): Xaa is A, C, G, P, M, V, I, L, Sce, or Sme
  MISC_FEATURE (112)..(122): Xaa is any amino acid
XXXXXXXXXXXNSXTPTDXIIXXILXXEXXXXXXXXXXXXXXXXXXXXXXXXXXXXXXXXXXXQXXXXXXXXXXXXXXXXXXXXXXXXXXXXXXXXXXXXXXXXXXXXSXXXXXXXXXXXXX

SEQ ID NO: 28 - protein, 172 aa, Artificial Sequence
  Synthetic
  MISC_FEATURE (1)..(1): Xaa is any amino acid or optionally absent
  MISC_FEATURE (2)..(22): Xaa is any amino acid
  MISC_FEATURE (24)..(25): Xaa is any amino acid
  MISC_FEATURE (26)..(27): Xaa is A, C, G, P, M, V, I, L, Selenomethionine (Sme), or Selenocysteine (Sce)
  MISC_FEATURE (28)..(29): Xaa is any amino acid
  MISC_FEATURE (30)..(30): Xaa is A, C, G, P, M, V, I, L, Sce or Sme
  MISC_FEATURE (31)..(31): Xaa is S, T, N,  or Q
  MISC_FEATURE (32)..(32): Xaa is A, C, G, P, M, V, I, L, Sce or Sme
  MISC_FEATURE (33)..(33): Xaa is S, T, N,  or Q
  MISC_FEATURE (34)..(34): Xaa is A, C, G, P, M, V, I, L, Sce or Sme
  MISC_FEATURE (35)..(36): Xaa is D or E
  MISC_FEATURE (37)..(37): Xaa is A, C, G, P, M, V, I, L, Sce or Sme
  MISC_FEATURE (38)..(39): Xaa is S, T, N,  or Q
  MISC_FEATURE (40)..(40): Xaa is F, W, or Y
  MISC_FEATURE (41)..(42): Xaa is A, C, G, P, M, V, I, L, Sce or Sme
  MISC_FEATURE (43)..(43): Xaa is D or E
  MISC_FEATURE (44)..(44): Xaa is A, C, G, P, M, V, I, L, Sce or Sme
  MISC_FEATURE (45)..(45): Xaa is R, H, or K
  MISC_FEATURE (46)..(46): Xaa is any amino acid
  MISC_FEATURE (47)..(47): Xaa is F, W, or Y
  MISC_FEATURE (48)..(48): Xaa is A, C, G, P, M, V, I, L, Sce or Sme
  MISC_FEATURE (49)..(51): Xaa is any amino acid
  MISC_FEATURE (52)..(52): Xaa is A, C, G, P, M, V, I, L, Sce or Sme
  MISC_FEATURE (53)..(53): Xaa is any amino acid
  MISC_FEATURE (54)..(56): Xaa is A, C, G, P, M, V, I, L, Sce or Sme
  MISC_FEATURE (57)..(57): Xaa is D or E
  MISC_FEATURE (58)..(58): Xaa is any amino acid
  MISC_FEATURE (59)..(59): Xaa is A, C, G, P, M, V, I, L, Sce or Sme
  MISC_FEATURE (60)..(61): Xaa is S, T, N,  or Q
  MISC_FEATURE (62)..(62): Xaa is D or E
  MISC_FEATURE (63)..(63): Xaa is A, C, G, P, M, V, I, L, Sce or Sme
  MISC_FEATURE (64)..(64): Xaa is any amino acid
  MISC_FEATURE (65)..(65): Xaa is R, H, or K
  MISC_FEATURE (66)..(68): Xaa is A, C, G, P, M, V, I, L, Sce or Sme
  MISC_FEATURE (69)..(69): Xaa is D or E
  MISC_FEATURE (70)..(71): Xaa is A, C, G, P, M, V, I, L, Sce or Sme
  MISC_FEATURE (72)..(72): Xaa is S, T, N,  or Q
  MISC_FEATURE (73)..(73): Xaa is any amino acid
  MISC_FEATURE (74)..(74): Xaa is A, C, G, P, M, V, I, L, Sce or Sme
  MISC_FEATURE (75)..(77): Xaa is any amino acid
  MISC_FEATURE (78)..(79): Xaa is A, C, G, P, M, V, I, L, Sce or Sme
  MISC_FEATURE (80)..(80): Xaa is any amino acid
  MISC_FEATURE (82)..(83): Xaa is any amino acid
  MISC_FEATURE (86)..(86): Xaa is F, W, or Y
  MISC_FEATURE (87)..(87): Xaa is A, C, G, P, M, V, I, L, Sce or Sme
  MISC_FEATURE (89)..(89): Xaa is any amino acid
  MISC_FEATURE (90)..(90): Xaa is A, C, G, P, M, V, I, L, Sce or Sme
  MISC_FEATURE (93)..(93): Xaa is any amino acid
  MISC_FEATURE (94)..(94): Xaa is F, W, or Y
  MISC_FEATURE (96)..(97): Xaa is any amino acid
  MISC_FEATURE (98)..(98): Xaa is A, C, G, P, M, V, I, L, Sce or Sme
  MISC_FEATURE (99)..(104): Xaa is any amino acid
  MISC_FEATURE (105)..(108): Xaa is A, C, G, P, M, V, I, L, Sce or Sme
  MISC_FEATURE (109)..(109): Xaa is S, T, N,  or Q
  MISC_FEATURE (110)..(110): Xaa is A, C, G, P, M, V, I, L, Sce or Sme
  MISC_FEATURE (111)..(111): Xaa is any amino acid
  MISC_FEATURE (112)..(112): Xaa is S, T, N,  or Q
  MISC_FEATURE (113)..(113): Xaa is A, C, G, P, M, V, I, L, Sce or Sme
  MISC_FEATURE (114)..(114): Xaa is R, H, or K
  MISC_FEATURE (115)..(115): Xaa is A, C, G, P, M, V, I, L, Sce or Sme
  MISC_FEATURE (116)..(116): Xaa is D or E
  MISC_FEATURE (117)..(118): Xaa is A, C, G, P, M, V, I, L, Sce or Sme
  MISC_FEATURE (119)..(119): Xaa is R, H, or K
  MISC_FEATURE (120)..(120): Xaa is S, T, N,  or Q
  MISC_FEATURE (121)..(122): Xaa is A, C, G, P, M, V, I, L, Sce or Sme
  MISC_FEATURE (123)..(123): Xaa is any amino acid
  MISC_FEATURE (124)..(124): Xaa is R, H, or K
  MISC_FEATURE (125)..(125): Xaa is A, C, G, P, M, V, I, L, Sce or Sme
  MISC_FEATURE (127)..(128): Xaa is R, H, or K
  MISC_FEATURE (129)..(129): Xaa is A, C, G, P, M, V, I, L, Sce or Sme
  MISC_FEATURE (131)..(131): Xaa is any amino acid
  MISC_FEATURE (132)..(132): Xaa is A, C, G, P, M, V, I, L, Sce or Sme
  MISC_FEATURE (135)..(136): Xaa is any amino acid
  MISC_FEATURE (139)..(139): Xaa is A, C, G, P, M, V, I, L, Sce or Sme
  MISC_FEATURE (142)..(142): Xaa is A, C, G, P, M, V, I, L, Sce or Sme
  MISC_FEATURE (145)..(145): Xaa is F, W, or Y
  MISC_FEATURE (146)..(146): Xaa is A, C, G, P, M, V, I, L, Sce or Sme
  MISC_FEATURE (149)..(149): Xaa is A, C, G, P, M, V, I, L, Sce or Sme
  MISC_FEATURE (150)..(150): Xaa is S, T, N,  or Q
  MISC_FEATURE (152)..(153): Xaa is A, C, G, P, M, V, I, L, Sce or Sme
  MISC_FEATURE (154)..(154): Xaa is any amino acid
  MISC_FEATURE (155)..(157): Xaa is A, C, G, P, M, V, I, L, Sce or Sme
  MISC_FEATURE (158)..(158): Xaa is R, H, or K
  MISC_FEATURE (159)..(160): Xaa is A, C, G, P, M, V, I, L, Sce or Sme
  MISC_FEATURE (161)..(161): Xaa is D or E
  MISC_FEATURE (162)..(172): Xaa is any amino acid
XXXXXXXXXXXXXXXXXXXXXXKXXXXXXXXXXXXXXXXXXXXXXXXXXXXXXXXXXXXXXXXXXXXXXXXXXXXXXXXXEXXIAXXLXXILXXMXXXXXXXXXXXXXXXXXXXXXXXXXXXXXXLXXXLXXTRXXGIXAEXAAXXLAXXDXXXXXXXXXXXXXXXXXXXXX

SEQ ID NO: 29 - protein, 123 aa, Artificial Sequence
  Synthetic
  MISC_FEATURE (1)..(1): Xaa ia any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(6): Xaa is A, C, G, P, M, V, I, L, Sce or Sme
  MISC_FEATURE (7)..(7): Xaa is D or E
  MISC_FEATURE (8)..(8): Xaa is A, C, G, P, M, V, I, L, Sce or Sme
  MISC_FEATURE (9)..(9): Xaa is S, T, N or Q
  MISC_FEATURE (10)..(10): Xaa is A, C, G, P, M, V, I, L, Sce or Sme
  MISC_FEATURE (11)..(11): Xaa is S, T, N or Q
  MISC_FEATURE (12)..(12): Xaa is A, C, G, P, M, V, I, L, Sce or Sme
  MISC_FEATURE (13)..(13): Xaa ia any amino acid
  MISC_FEATURE (14)..(14): Xaa is A, C, G, P, M, V, I, L, Sce or Sme
  MISC_FEATURE (15)..(15): Xaa ia any amino acid
  MISC_FEATURE (16)..(16): Xaa is S, T, N or Q
  MISC_FEATURE (17)..(17): Xaa ia any amino acid
  MISC_FEATURE (18)..(19): Xaa is A, C, G, P, M, V, I, L, Sce or Sme
  MISC_FEATURE (20)..(20): Xaa ia any amino acid
  MISC_FEATURE (21)..(22): Xaa is A, C, G, P, M, V, I, L, Sce or Sme
  MISC_FEATURE (23)..(23): Xaa is D or E
  MISC_FEATURE (24)..(24): Xaa ia any amino acid
  MISC_FEATURE (25)..(25): Xaa is A, C, G, P, M, V, I, L, Sce or Sme
  MISC_FEATURE (26)..(26): Xaa is S, T, N or Q
  MISC_FEATURE (29)..(29): Xaa is A, C, G, P, M, V, I, L, Sce or Sme
  MISC_FEATURE (33)..(33): Xaa ia any amino acid
  MISC_FEATURE (35)..(35): Xaa is F, W, or Y
  MISC_FEATURE (36)..(36): Xaa is A, C, G, P, M, V, I, L, Sce or Sme
  MISC_FEATURE (37)..(37): Xaa is D or E
  MISC_FEATURE (38)..(38): Xaa is A, C, G, P, M, V, I, L, Sce or Sme
  MISC_FEATURE (39)..(39): Xaa ia any amino acid
  MISC_FEATURE (40)..(40): Xaa is A, C, G, P, M, V, I, L, Sce or Sme
  MISC_FEATURE (41)..(41): Xaa is R, H, or K
  MISC_FEATURE (42)..(43): Xaa ia any amino acid
  MISC_FEATURE (44)..(44): Xaa is F, W, or Y
  MISC_FEATURE (45)..(45): Xaa is A, C, G, P, M, V, I, L, Sce or Sme
  MISC_FEATURE (46)..(46): Xaa ia any amino acid
  MISC_FEATURE (47)..(47): Xaa is A, C, G, P, M, V, I, L, Sce or Sme
  MISC_FEATURE (48)..(48): Xaa ia any amino acid
  MISC_FEATURE (49)..(49): Xaa is A, C, G, P, M, V, I, L, Sce or Sme
  MISC_FEATURE (50)..(50): Xaa is F, W, or Y
  MISC_FEATURE (51)..(51): Xaa ia any amino acid
  MISC_FEATURE (52)..(52): Xaa is S, T, N or Q
  MISC_FEATURE (53)..(53): Xaa is A, C, G, P, M, V, I, L, Sce or Sme
  MISC_FEATURE (54)..(54): Xaa ia any amino acid
  MISC_FEATURE (55)..(55): Xaa is A, C, G, P, M, V, I, L, Sce or Sme
  MISC_FEATURE (56)..(58): Xaa ia any amino acid
  MISC_FEATURE (59)..(59): Xaa is R, H, or K
  MISC_FEATURE (60)..(60): Xaa ia any amino acid
  MISC_FEATURE (61)..(61): Xaa is F, W, or Y
  MISC_FEATURE (62)..(62): Xaa ia any amino acid
  MISC_FEATURE (63)..(63): Xaa is R, H, or K
  MISC_FEATURE (64)..(66): Xaa ia any amino acid
  MISC_FEATURE (67)..(67): Xaa is S, T, N or Q
  MISC_FEATURE (68)..(69): Xaa ia any amino acid
  MISC_FEATURE (70)..(70): Xaa ia any amino acid
  MISC_FEATURE (72)..(72): Xaa ia any amino acid
  MISC_FEATURE (77)..(77): Xaa is R, H, or K
  MISC_FEATURE (80)..(81): Xaa ia any amino acid
  MISC_FEATURE (84)..(84): Xaa ia any amino acid
  MISC_FEATURE (87)..(89): Xaa ia any amino acid
  MISC_FEATURE (90)..(90): Xaa ia any amino acid
  MISC_FEATURE (91)..(96): Xaa ia any amino acid
  MISC_FEATURE (97)..(98): Xaa ia any amino acid
  MISC_FEATURE (99)..(100): Xaa ia any amino acid
  MISC_FEATURE (101)..(101): Xaa is S, T, N or Q
  MISC_FEATURE (102)..(102): Xaa ia any amino acid
  MISC_FEATURE (103)..(103): Xaa is S, T, N or Q
  MISC_FEATURE (104)..(104): Xaa ia any amino acid
  MISC_FEATURE (105)..(105): Xaa is D or E
  MISC_FEATURE (106)..(106): Xaa ia any amino acid
  MISC_FEATURE (107)..(107): Xaa is R, H, or K
  MISC_FEATURE (108)..(108): Xaa ia any amino acid
  MISC_FEATURE (109)..(109): Xaa ia any amino acid
  MISC_FEATURE (110)..(110): Xaa is D or E
  MISC_FEATURE (111)..(111): Xaa ia any amino acid
  MISC_FEATURE (113)..(113): Xaa is S, T, N or Q
  MISC_FEATURE (118)..(123): Xaa ia any amino acid
XXXXXXXXXXXXXXXXXXXXXXXXXXKAXFASXQXXXXXXXXXXXXXXXXXXXXXXXXXXXXXXXXXXXXGXDIATXTLXXASXCAXXXXXXXXXXXXXXXXXXXXXXXXXLXYAKRXXXXXX

SEQ ID NO: 30 - protein, 158 aa, Artificial Sequence
  Synthetic
  MISC_FEATURE (1)..(1): Xaa is any amino acid or is optionally absent
  MISC_FEATURE (2)..(4): Xaa is any amino acid
  MISC_FEATURE (5)..(7): Xaa is S, T, N or Q
  MISC_FEATURE (8)..(8): Xaa is F, W, or Y
  MISC_FEATURE (9)..(9): Xaa is A, C, G, P, M, V, I, L, Selenomethionine (Sme), or Selenocysteine (Sce)
  MISC_FEATURE (10)..(10): Xaa is S, T, N or Q
  MISC_FEATURE (11)..(11): Xaa is A, C, G, P, M, V, I, L, Sce or Sme
  MISC_FEATURE (12)..(12): Xaa is S, T, N or Q
  MISC_FEATURE (13)..(14): Xaa is A, C, G, P, M, V, I, L, Sce or Sme
  MISC_FEATURE (15)..(15): Xaa is S, T, N or Q
  MISC_FEATURE (16)..(16): Xaa is A, C, G, P, M, V, I, L, Sce or Sme
  MISC_FEATURE (17)..(17): Xaa is R, H, or K
  MISC_FEATURE (18)..(18): Xaa is D or E
  MISC_FEATURE (19)..(21): Xaa is any amino acid
  MISC_FEATURE (22)..(22): Xaa is A, C, G, P, M, V, I, L, Sce or Sme
  MISC_FEATURE (23)..(23): Xaa is S, T, N or Q
  MISC_FEATURE (24)..(24): Xaa is F, W, or Y
  MISC_FEATURE (25)..(27): Xaa is A, C, G, P, M, V, I, L, Sce or Sme
  MISC_FEATURE (28)..(28): Xaa is R, H, or K
  MISC_FEATURE (29)..(29): Xaa is A, C, G, P, M, V, I, L, Sce or Sme
  MISC_FEATURE (30)..(31): Xaa is any amino acid
  MISC_FEATURE (32)..(32): Xaa is S, T, N or Q
  MISC_FEATURE (33)..(33): Xaa is A, C, G, P, M, V, I, L, Sce or Sme
  MISC_FEATURE (34)..(34): Xaa is F, W, or Y
  MISC_FEATURE (35)..(36): Xaa is A, C, G, P, M, V, I, L, Sce or Sme
  MISC_FEATURE (37)..(37): Xaa is D or E
  MISC_FEATURE (38)..(38): Xaa is any amino acid
  MISC_FEATURE (39)..(39): Xaa is A, C, G, P, M, V, I, L, Sce or Sme
  MISC_FEATURE (40)..(40): Xaa is D or E
  MISC_FEATURE (41)..(41): Xaa is A, C, G, P, M, V, I, L, Sce or Sme
  MISC_FEATURE (42)..(42): Xaa is D or E
  MISC_FEATURE (43)..(44): Xaa is A, C, G, P, M, V, I, L, Sce or Sme
  MISC_FEATURE (45)..(46): Xaa is any amino acid
  MISC_FEATURE (47)..(47): Xaa is R, H, or K
  MISC_FEATURE (48)..(48): Xaa is A, C, G, P, M, V, I, L, Sce or Sme
  MISC_FEATURE (51)..(51): Xaa is A, C, G, P, M, V, I, L, Sce or Sme
  MISC_FEATURE (55)..(55): Xaa is S, T, N or Q
  MISC_FEATURE (58)..(59): Xaa is A, C, G, P, M, V, I, L, Sce or Sme
  MISC_FEATURE (61)..(61): Xaa is D or E
  MISC_FEATURE (62)..(65): Xaa is any amino acid
  MISC_FEATURE (66)..(66): Xaa is F, W, or Y
  MISC_FEATURE (67)..(67): Xaa is any amino acid
  MISC_FEATURE (68)..(69): Xaa is A, C, G, P, M, V, I, L, Sce or Sme
  MISC_FEATURE (70)..(70): Xaa is R, H, or K
  MISC_FEATURE (71)..(71): Xaa is A, C, G, P, M, V, I, L, Sce or Sme
  MISC_FEATURE (72)..(72): Xaa is R, H, or K
  MISC_FEATURE (73)..(73): Xaa is A, C, G, P, M, V, I, L, Sce or Sme
  MISC_FEATURE (74)..(74): Xaa is R, H, or K
  MISC_FEATURE (75)..(76): Xaa is A, C, G, P, M, V, I, L, Sce or Sme
  MISC_FEATURE (77)..(77): Xaa is D or E
  MISC_FEATURE (78)..(78): Xaa is A, C, G, P, M, V, I, L, Sce or Sme
  MISC_FEATURE (79)..(79): Xaa is any amino acid
  MISC_FEATURE (80)..(80): Xaa is D or E
  MISC_FEATURE (81)..(81): Xaa is R, H, or K
  MISC_FEATURE (82)..(84): Xaa is any amino acid
  MISC_FEATURE (85)..(85): Xaa is S, T, N or Q
  MISC_FEATURE (86)..(86): Xaa is A, C, G, P, M, V, I, L, Sce or Sme
  MISC_FEATURE (87)..(87): Xaa is any amino acid
  MISC_FEATURE (88)..(88): Xaa is A, C, G, P, M, V, I, L, Sce or Sme
  MISC_FEATURE (89)..(89): Xaa is any amino acid
  MISC_FEATURE (90)..(90): Xaa is A, C, G, P, M, V, I, L, Sce or Sme
  MISC_FEATURE (91)..(91): Xaa is D or E
  MISC_FEATURE (92)..(93): Xaa is A, C, G, P, M, V, I, L, Sce or Sme
  MISC_FEATURE (94)..(105): Xaa is any amino acid
  MISC_FEATURE (106)..(106): Xaa is A, C, G, P, M, V, I, L, Sce or Sme
  MISC_FEATURE (107)..(108): Xaa is D or E
  MISC_FEATURE (109)..(109): Xaa is any amino acid
  MISC_FEATURE (110)..(110): Xaa is A, C, G, P, M, V, I, L, Sce or Sme
  MISC_FEATURE (111)..(111): Xaa is R, H, or K
  MISC_FEATURE (114)..(114): Xaa is A, C, G, P, M, V, I, L, Sce or Sme
  MISC_FEATURE (115)..(115): Xaa is any amino acid
  MISC_FEATURE (118)..(118): Xaa is A, C, G, P, M, V, I, L, Sce or Sme
  MISC_FEATURE (120)..(120): Xaa is A, C, G, P, M, V, I, L, Sce or Sme
  MISC_FEATURE (121)..(121): Xaa is any amino acid
  MISC_FEATURE (122)..(122): Xaa is A, C, G, P, M, V, I, L, Sce or Sme
  MISC_FEATURE (123)..(123): Xaa is any amino acid
  MISC_FEATURE (124)..(124): Xaa is D or E
  MISC_FEATURE (125)..(127): Xaa is any amino acid
  MISC_FEATURE (128)..(129): Xaa is A, C, G, P, M, V, I, L, Sce or Sme
  MISC_FEATURE (130)..(131): Xaa is S, T, N or Q
  MISC_FEATURE (132)..(132): Xaa is F, W, or Y
  MISC_FEATURE (133)..(134): Xaa is any amino acid
  MISC_FEATURE (135)..(135): Xaa is R, H, or K
  MISC_FEATURE (136)..(142): Xaa is any amino acid
  MISC_FEATURE (143)..(143): Xaa is S, T, N or Q
  MISC_FEATURE (144)..(144): Xaa is D or E
  MISC_FEATURE (145)..(145): Xaa is any amino acid
  MISC_FEATURE (146)..(146): Xaa is F, W, or Y
  MISC_FEATURE (147)..(147): Xaa is any amino acid
  MISC_FEATURE (148)..(148): Xaa is A, C, G, P, M, V, I, L, Sce or Sme
  MISC_FEATURE (149)..(149): Xaa is D or E
  MISC_FEATURE (150)..(150): Xaa is R, H, or K
  MISC_FEATURE (151)..(152): Xaa is any amino acid
  MISC_FEATURE (153)..(154): Xaa is F, W, or Y
  MISC_FEATURE (155)..(158): Xaa is any amino acid
XXXXXXXXXXXXXXXXXXXXXXXXXXXXXXXXXXXXXXXXXXXXXXXXIGXRAAXIFXXDXXXXXXXXXXXXXXXXXXXXXXXXXXXXXXXXXXXXXXXXXXXXXXXXXXXLAXXVAXQXXXXXXXXXXXXXXXXXXXXXXXXXXXXXXXXXXXXXXX

SEQ ID NO: 31 - protein, 113 aa, Artificial Sequence
  Synthetic
  MISC_FEATURE (1)..(1): Xaa is any amino acid or is optionally absent
  MISC_FEATURE (2)..(4): Xaa is A, C, G, P, M, V, I, L, Selenomethionine (Sme), or Selenocysteine (Sce)
  MISC_FEATURE (5)..(6): Xaa is S, T, N, or Q
  MISC_FEATURE (7)..(7): Xaa is F, W, or Y
  MISC_FEATURE (8)..(8): Xaa is A, C, G, P, M, V, I, L, Sce, Sme
  MISC_FEATURE (9)..(10): Xaa is S, T, N, or Q
  MISC_FEATURE (11)..(11): Xaa is any amino acid
  MISC_FEATURE (12)..(12): Xaa is A, C, G, P, M, V, I, L, Sce, Sme
  MISC_FEATURE (13)..(14): Xaa is any amino acid
  MISC_FEATURE (16)..(17): Xaa is any amino acid
  MISC_FEATURE (20)..(21): Xaa is A, C, G, P, M, V, I, L, Sce, Sme
  MISC_FEATURE (24)..(24): Xaa is F, W, or Y
  MISC_FEATURE (28)..(28): Xaa is S, T, N, or Q
  MISC_FEATURE (32)..(32): Xaa is A, C, G, P, M, V, I, L, Sce, Sme
  MISC_FEATURE (33)..(33): Xaa is any amino acid
  MISC_FEATURE (34)..(34): Xaa is R, H, or K
  MISC_FEATURE (35)..(35): Xaa is any amino acid
  MISC_FEATURE (37)..(37): Xaa is D or E
  MISC_FEATURE (38)..(41): Xaa is A, C, G, P, M, V, I, L, Sce, Sme
  MISC_FEATURE (42)..(42): Xaa is S, T, N, or Q
  MISC_FEATURE (43)..(43): Xaa is F, W, or Y
  MISC_FEATURE (44)..(44): Xaa is R, H, or K
  MISC_FEATURE (45)..(46): Xaa is any amino acid
  MISC_FEATURE (47)..(47): Xaa is S, T, N, or Q
  MISC_FEATURE (48)..(49): Xaa is A, C, G, P, M, V, I, L, Sce, Sme
  MISC_FEATURE (50)..(50): Xaa is R, H, or K
  MISC_FEATURE (51)..(52): Xaa is F, W, or Y
  MISC_FEATURE (53)..(53): Xaa is A, C, G, P, M, V, I, L, Sce, Sme
  MISC_FEATURE (54)..(54): Xaa is S, T, N, or Q
  MISC_FEATURE (55)..(57): Xaa is any amino acid
  MISC_FEATURE (58)..(61): Xaa is A, C, G, P, M, V, I, L, Sce, Sme
  MISC_FEATURE (62)..(62): Xaa is R, H, or K
  MISC_FEATURE (63)..(63): Xaa is A, C, G, P, M, V, I, L, Sce, Sme
  MISC_FEATURE (64)..(64): Xaa is D or E
  MISC_FEATURE (65)..(65): Xaa is A, C, G, P, M, V, I, L, Sce, Sme
  MISC_FEATURE (66)..(67): Xaa is any amino acid
  MISC_FEATURE (68)..(68): Xaa is A, C, G, P, M, V, I, L, Sce, Sme
  MISC_FEATURE (69)..(69): Xaa is any amino acid
  MISC_FEATURE (70)..(70): Xaa is A, C, G, P, M, V, I, L, Sce, Sme
  MISC_FEATURE (71)..(72): Xaa is any amino acid
  MISC_FEATURE (73)..(73): Xaa is D or E
  MISC_FEATURE (74)..(74): Xaa is A, C, G, P, M, V, I, L, Sce, Sme
  MISC_FEATURE (75)..(75): Xaa is any amino acid
  MISC_FEATURE (76)..(76): Xaa is R, H, or K
  MISC_FEATURE (77)..(77): Xaa is A, C, G, P, M, V, I, L, Sce, Sme
  MISC_FEATURE (78)..(79): Xaa is S, T, N, or Q
  MISC_FEATURE (81)..(81): Xaa is A, C, G, P, M, V, I, L, Sce, Sme
  MISC_FEATURE (82)..(82): Xaa is S, T, N, or Q
  MISC_FEATURE (85)..(85): Xaa is A, C, G, P, M, V, I, L, Sce, Sme
  MISC_FEATURE (89)..(89): Xaa is A, C, G, P, M, V, I, L, Sce, Sme
  MISC_FEATURE (90)..(90): Xaa is any amino acid
  MISC_FEATURE (91)..(91): Xaa is A, C, G, P, M, V, I, L, Sce, Sme
  MISC_FEATURE (92)..(92): Xaa is any amino acid
  MISC_FEATURE (93)..(93): Xaa is A, C, G, P, M, V, I, L, Sce, Sme
  MISC_FEATURE (94)..(94): Xaa is any amino acid
  MISC_FEATURE (95)..(95): Xaa is R, H, or K
  MISC_FEATURE (96)..(96): Xaa is A, C, G, P, M, V, I, L, Sce, Sme
  MISC_FEATURE (97)..(97): Xaa is F, W, or Y
  MISC_FEATURE (98)..(99): Xaa is A, C, G, P, M, V, I, L, Sce, Sme
  MISC_FEATURE (100)..(101): Xaa is F, W, or Y
  MISC_FEATURE (102)..(102): Xaa is any amino acid
  MISC_FEATURE (103)..(103): Xaa is A, C, G, P, M, V, I, L, Sce, Sme
  MISC_FEATURE (104)..(104): Xaa is any amino acid
  MISC_FEATURE (105)..(105): Xaa is R, H, or K
  MISC_FEATURE (106)..(107): Xaa is A, C, G, P, M, V, I, L, Sce, Sme
  MISC_FEATURE (108)..(108): Xaa is any amino acid
  MISC_FEATURE (109)..(109): Xaa is S, T, N, or Q
  MISC_FEATURE (110)..(110): Xaa is A, C, G, P, M, V, I, L, Sce, Sme
  MISC_FEATURE (111)..(113): Xaa is any amino acid
XXXXXXXXXXXXXXHXXLLXXIIXRIVXRVVXXXXEXXXXXXXXXXXXXXXXXXXXXXXXXXXXXXXXXXXXXXXXXXXIXXAAXTAVXXXXXXXXXXXXXXXXXXXXXXXXX

SEQ ID NO: 32 - protein, 159 aa, Artificial Sequence; identical to SEQ ID NO: 22
  Synthetic
  MISC_FEATURE (1)..(1): Xaa is any amino acid or optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is D or E
  MISC_FEATURE (4)..(7): Xaa is A, C, G, P, M, V, I, L, Sme, or Sce
  MISC_FEATURE (8)..(8): Xaa is D or E
  MISC_FEATURE (9)..(9): Xaa is A, C, G, P, M, V, I, L, Sme, or Sce
  MISC_FEATURE (10)..(10): Xaa is R, H or K
  MISC_FEATURE (11)..(11): Xaa is D or E
  MISC_FEATURE (12)..(12): Xaa is A, C, G, P, M, V, I, L, Sme, or Sce
  MISC_FEATURE (13)..(13): Xaa is S, T, N, or Q
  MISC_FEATURE (14)..(15): Xaa is A, C, G, P, M, V, I, L, Sme, or Sce
  MISC_FEATURE (16)..(16): Xaa is D or E
  MISC_FEATURE (17)..(20): Xaa is A, C, G, P, M, V, I, L, Sme, or Sce
  MISC_FEATURE (21)..(21): Xaa is F, W or Y
  MISC_FEATURE (22)..(22): Xaa is A, C, G, P, M, V, I, L, Sme, or Sce
  MISC_FEATURE (23)..(23): Xaa is S, T, N, or Q
  MISC_FEATURE (24)..(25): Xaa is A, C, G, P, M, V, I, L, Sme, or Sce
  MISC_FEATURE (26)..(26): Xaa is D or E
  MISC_FEATURE (27)..(27): Xaa is A, C, G, P, M, V, I, L, Sme, or Sce
  MISC_FEATURE (28)..(28): Xaa is D or E
  MISC_FEATURE (29)..(29): Xaa is A, C, G, P, M, V, I, L, Sme, or Sce
  MISC_FEATURE (30)..(30): Xaa is R, H or K
  MISC_FEATURE (31)..(32): Xaa is A, C, G, P, M, V, I, L, Sme, or Sce
  MISC_FEATURE (33)..(33): Xaa is D or E
  MISC_FEATURE (34)..(36): Xaa is A, C, G, P, M, V, I, L, Sme, or Sce
  MISC_FEATURE (37)..(37): Xaa is S, T, N, or Q
  MISC_FEATURE (38)..(39): Xaa is A, C, G, P, M, V, I, L, Sme, or Sce
  MISC_FEATURE (40)..(40): Xaa is D or E
  MISC_FEATURE (41)..(41): Xaa is A, C, G, P, M, V, I, L, Sme, or Sce
  MISC_FEATURE (42)..(42): Xaa is R, H or K
  MISC_FEATURE (43)..(43): Xaa is A, C, G, P, M, V, I, L, Sme, or Sce
  MISC_FEATURE (44)..(44): Xaa is D or E
  MISC_FEATURE (45)..(45): Xaa is A, C, G, P, M, V, I, L, Sme, or Sce
  MISC_FEATURE (46)..(46): Xaa is D or E
  MISC_FEATURE (47)..(47): Xaa is A, C, G, P, M, V, I, L, Sme, or Sce
  MISC_FEATURE (48)..(48): Xaa is R, H or K
  MISC_FEATURE (49)..(50): Xaa is A, C, G, P, M, V, I, L, Sme, or Sce
  MISC_FEATURE (51)..(51): Xaa is R, H or K
  MISC_FEATURE (52)..(53): Xaa is S, T, N, or Q
  MISC_FEATURE (54)..(54): Xaa is A, C, G, P, M, V, I, L, Sme, or Sce
  MISC_FEATURE (55)..(55): Xaa is S, T, N, or Q
  MISC_FEATURE (56)..(56): Xaa is A, C, G, P, M, V, I, L, Sme, or Sce
  MISC_FEATURE (57)..(57): Xaa is F, W or Y
  MISC_FEATURE (58)..(58): Xaa is A, C, G, P, M, V, I, L, Sme, or Sce
  MISC_FEATURE (59)..(59): Xaa is D or E
  MISC_FEATURE (60)..(60): Xaa is A, C, G, P, M, V, I, L, Sme, or Sce
  MISC_FEATURE (61)..(62): Xaa is F, W or Y
  MISC_FEATURE (63)..(64): Xaa is A, C, G, P, M, V, I, L, Sme, or Sce
  MISC_FEATURE (65)..(65): Xaa is F, W or Y
  MISC_FEATURE (66)..(66): Xaa is A, C, G, P, M, V, I, L, Sme, or Sce
  MISC_FEATURE (67)..(67): Xaa is S, T, N, or Q
  MISC_FEATURE (68)..(68): Xaa is A, C, G, P, M, V, I, L, Sme, or Sce
  MISC_FEATURE (84)..(84): Xaa is S, T, N, or Q
  MISC_FEATURE (85)..(90): Xaa is A, C, G, P, M, V, I, L, Sme, or Sce
  MISC_FEATURE (91)..(92): Xaa is D or E
  MISC_FEATURE (93)..(94): Xaa is A, C, G, P, M, V, I, L, Sme, or Sce
  MISC_FEATURE (95)..(95): Xaa is R, H or K
  MISC_FEATURE (96)..(96): Xaa is F, W or Y
  MISC_FEATURE (97)..(98): Xaa is A, C, G, P, M, V, I, L, Sme, or Sce
  MISC_FEATURE (99)..(99): Xaa is S, T, N, or Q
  MISC_FEATURE (100)..(102): Xaa is A, C, G, P, M, V, I, L, Sme, or Sce
  MISC_FEATURE (103)..(103): Xaa is D or E
  MISC_FEATURE (104)..(104): Xaa is R, H or K
  MISC_FEATURE (105)..(105): Xaa is D or E
  MISC_FEATURE (106)..(107): Xaa is R, H or K
  MISC_FEATURE (108)..(109): Xaa is A, C, G, P, M, V, I, L, Sme, or Sce
  MISC_FEATURE (110)..(110): Xaa is F, W or Y
  MISC_FEATURE (111)..(113): Xaa is A, C, G, P, M, V, I, L, Sme, or Sce
  MISC_FEATURE (122)..(123): Xaa is S, T, N, or Q
  MISC_FEATURE (124)..(124): Xaa is A, C, G, P, M, V, I, L, Sme, or Sce
  MISC_FEATURE (125)..(125): Xaa is D or E
  MISC_FEATURE (126)..(126): Xaa is R, H or K
  MISC_FEATURE (127)..(127): Xaa is S, T, N, or Q
  MISC_FEATURE (128)..(128): Xaa is A, C, G, P, M, V, I, L, Sme, or Sce
  MISC_FEATURE (129)..(129): Xaa is F, W or Y
  MISC_FEATURE (130)..(130): Xaa is A, C, G, P, M, V, I, L, Sme, or Sce
  MISC_FEATURE (131)..(132): Xaa is R, H or K
  MISC_FEATURE (133)..(133): Xaa is A, C, G, P, M, V, I, L, Sme, or Sce
  MISC_FEATURE (134)..(136): Xaa is D or E
  MISC_FEATURE (137)..(137): Xaa is S, T, N, or Q
  MISC_FEATURE (138)..(140): Xaa is A, C, G, P, M, V, I, L, Sme, or Sce
  MISC_FEATURE (141)..(141): Xaa is R, H or K
  MISC_FEATURE (142)..(143): Xaa is F, W or Y
  MISC_FEATURE (144)..(144): Xaa is D or E
  MISC_FEATURE (153)..(153): Xaa is R, H or K
  MISC_FEATURE (154)..(154): Xaa is F, W or Y
  MISC_FEATURE (155)..(155): Xaa is S, T, N, or Q
  MISC_FEATURE (156)..(156): Xaa is A, C, G, P, M, V, I, L, Sme, or Sce
  MISC_FEATURE (157)..(157): Xaa is S, T, N, or Q
  MISC_FEATURE (158)..(158): Xaa is A, C, G, P, M, V, I, L, Sme, or Sce
  MISC_FEATURE (159)..(159): Xaa is R, H or K

SEQ ID NO: 33 - protein, 184 aa, Artificial Sequence; identical to SEQ ID NO: 23
  Synthetic
  MISC_FEATURE (1)..(1): X is any amino acid or is optionally absent
  MISC_FEATURE (2)..(3): X is S, T, N or Q
  MISC_FEATURE (4)..(8): Xaa is A, C, G, P, M, V, I, L, Selenomethionine (Sme), or Selenocysteine (Sce)
  MISC_FEATURE (9)..(9): X is D or E
  MISC_FEATURE (10)..(10): X is A, C, G, P, M, V, I, L, Sce or Sme
  MISC_FEATURE (11)..(12): X is S, T, N or Q
  MISC_FEATURE (13)..(14): X is A, C, G, P, M, V, I, L, Sce or Sme
  MISC_FEATURE (15)..(15): X is R, H, or K
  MISC_FEATURE (16)..(17): X is A, C, G, P, M, V, I, L, Sce or Sme
  MISC_FEATURE (18)..(18): X is D or E
  MISC_FEATURE (19)..(20): X is A, C, G, P, M, V, I, L, Sce or Sme
  MISC_FEATURE (21)..(21): X is D or E
  MISC_FEATURE (22)..(24): X is A, C, G, P, M, V, I, L, Sce or Sme
  MISC_FEATURE (25)..(25): X is R, H, or K
  MISC_FEATURE (26)..(26): X is S, T, N or Q
  MISC_FEATURE (27)..(27): X is A, C, G, P, M, V, I, L, Sce or Sme
  MISC_FEATURE (28)..(28): X is S, T, N or Q
  MISC_FEATURE (29)..(29): X is A, C, G, P, M, V, I, L, Sce or Sme
  MISC_FEATURE (30)..(30): X is D or E
  MISC_FEATURE (31)..(33): X is A, C, G, P, M, V, I, L, Sce or Sme
  MISC_FEATURE (34)..(34): X is S, T, N or Q
  MISC_FEATURE (35)..(35): X is R, H, or K
  MISC_FEATURE (36)..(36): X is S, T, N or Q
  MISC_FEATURE (37)..(37): X is A, C, G, P, M, V, I, L, Sce or Sme
  MISC_FEATURE (38)..(38): X is S, T, N or Q
  MISC_FEATURE (39)..(40): X is A, C, G, P, M, V, I, L, Sce or Sme
  MISC_FEATURE (41)..(41): X is R, H, or K
  MISC_FEATURE (42)..(42): X is F, W, or Y
  MISC_FEATURE (43)..(48): X is A, C, G, P, M, V, I, L, Sce or Sme
  MISC_FEATURE (49)..(49): X is D or E
  MISC_FEATURE (50)..(53): X is A, C, G, P, M, V, I, L, Sce or Sme
  MISC_FEATURE (54)..(55): X is S, T, N or Q
  MISC_FEATURE (56)..(57): X is A, C, G, P, M, V, I, L, Sce or Sme
  MISC_FEATURE (58)..(58): X is D or E
  MISC_FEATURE (59)..(59): X is S, T, N or Q
  MISC_FEATURE (60)..(60): X is A, C, G, P, M, V, I, L, Sce or Sme
  MISC_FEATURE (61)..(63): X is S, T, N or Q
  MISC_FEATURE (64)..(65): X is A, C, G, P, M, V, I, L, Sce or Sme
  MISC_FEATURE (66)..(66): X is D or E
  MISC_FEATURE (67)..(69): X is A, C, G, P, M, V, I, L, Sce or Sme
  MISC_FEATURE (70)..(70): X is D or E
  MISC_FEATURE (71)..(71): X is S, T, N or Q
  MISC_FEATURE (72)..(75): X is A, C, G, P, M, V, I, L, Sce or Sme
  MISC_FEATURE (76)..(76): X is S, T, N or Q
  MISC_FEATURE (77)..(77): X is A, C, G, P, M, V, I, L, Sce or Sme
  MISC_FEATURE (78)..(78): X is R, H, or K
  MISC_FEATURE (79)..(79): X is A, C, G, P, M, V, I, L, Sce or Sme
  MISC_FEATURE (80)..(80): X is S, T, N or Q
  MISC_FEATURE (81)..(85): X is A, C, G, P, M, V, I, L, Sce or Sme
  MISC_FEATURE (86)..(86): X is S, T, N or Q
  MISC_FEATURE (87)..(88): X is A, C, G, P, M, V, I, L, Sce or Sme
  MISC_FEATURE (89)..(90): X is S, T, N or Q
  MISC_FEATURE (91)..(91): X is A, C, G, P, M, V, I, L, Sce or Sme
  MISC_FEATURE (92)..(92): X is D or E
  MISC_FEATURE (93)..(94): X is R, H, or K
  MISC_FEATURE (95)..(95): X is S, T, N or Q
  MISC_FEATURE (97)..(97): X is A, C, G, P, M, V, I, L, Sce or Sme
  MISC_FEATURE (98)..(98): X is S, T, N or Q
  MISC_FEATURE (99)..(100): X is A, C, G, P, M, V, I, L, Sce or Sme
  MISC_FEATURE (101)..(101): X is D or E
  MISC_FEATURE (102)..(102): X is S, T, N or Q
  MISC_FEATURE (103)..(103): X is F, W, or Y
  MISC_FEATURE (104)..(104): X is S, T, N or Q
  MISC_FEATURE (105)..(109): X is A, C, G, P, M, V, I, L, Sce or Sme
  MISC_FEATURE (110)..(110): X is S, T, N or Q
  MISC_FEATURE (111)..(112): X is A, C, G, P, M, V, I, L, Sce or Sme
  MISC_FEATURE (113)..(113): X is D or E
  MISC_FEATURE (116)..(116): X is A, C, G, P, M, V, I, L, Sce or Sme
  MISC_FEATURE (121)..(121): X is A, C, G, P, M, V, I, L, Sce or Sme
  MISC_FEATURE (122)..(122): X is S, T, N or Q
  MISC_FEATURE (123)..(124): X is A, C, G, P, M, V, I, L, Sce or Sme
  MISC_FEATURE (125)..(125): X is R, H, or K
  MISC_FEATURE (126)..(126): X is A, C, G, P, M, V, I, L, Sce or Sme
  MISC_FEATURE (127)..(127): X is R, H, or K
  MISC_FEATURE (128)..(129): X is A, C, G, P, M, V, I, L, Sce or Sme
  MISC_FEATURE (130)..(130): X is F, W, or Y
  MISC_FEATURE (131)..(134): X is A, C, G, P, M, V, I, L, Sce or Sme
  MISC_FEATURE (135)..(135): X is R, H, or K
  MISC_FEATURE (136)..(136): X is A, C, G, P, M, V, I, L, Sce or Sme
  MISC_FEATURE (137)..(137): X is F, W, or Y
  MISC_FEATURE (138)..(142): X is A, C, G, P, M, V, I, L, Sce or Sme
  MISC_FEATURE (158)..(158): X is A, C, G, P, M, V, I, L, Sce or Sme
  MISC_FEATURE (161)..(161): X is R, H, or K
  MISC_FEATURE (162)..(165): X is A, C, G, P, M, V, I, L, Sce or Sme
  MISC_FEATURE (166)..(166): X is F, W, or Y
  MISC_FEATURE (173)..(173): X is A, C, G, P, M, V, I, L, Sce or Sme
  MISC_FEATURE (174)..(174): X is R, H, or K
  MISC_FEATURE (175)..(175): X is D or E
  MISC_FEATURE (176)..(177): X is A, C, G, P, M, V, I, L, Sce or Sme
  MISC_FEATURE (178)..(178): X is F, W, or Y
  MISC_FEATURE (179)..(179): X is R, H, or K
  MISC_FEATURE (180)..(180): X is S, T, N or Q
  MISC_FEATURE (181)..(182): X is A, C, G, P, M, V, I, L, Sce or Sme
  MISC_FEATURE (183)..(183): X is D or E
  MISC_FEATURE (184)..(184): X is A, C, G, P, M, V, I, L, Sce or Sme

SEQ ID NO: 34 - protein, 103 aa, Artificial Sequence; identical to SEQ ID NO: 24
  Synthetic
  MISC_FEATURE (1)..(1): X is any amino acid or is optionally absent
  MISC_FEATURE (2)..(3): X is D or E
  MISC_FEATURE (4)..(7): Xaa is A, C, G, P, M, V, I, L, Selenomethionine (Sme), or Selenocysteine (Sce)
  MISC_FEATURE (8)..(8): X is S, T, N, or Q
  MISC_FEATURE (9)..(10): X is A, C, G, P, M, V, I, L, Sce or Sme
  MISC_FEATURE (11)..(11): X is S, T, N, or Q
  MISC_FEATURE (18)..(19): X is A, C, G, P, M, V, I, L, Sce or Sme
  MISC_FEATURE (21)..(23): X is A, C, G, P, M, V, I, L, Sce or Sme
  MISC_FEATURE (24)..(25): X is D or E
  MISC_FEATURE (26)..(26): X is R, H, or K
  MISC_FEATURE (27)..(31): X is A, C, G, P, M, V, I, L, Sce or Sme
  MISC_FEATURE (32)..(32): X is S, T, N, or Q
  MISC_FEATURE (34)..(34): X is A, C, G, P, M, V, I, L, Sce or Sme
  MISC_FEATURE (39)..(39): X is S, T, N, or Q
  MISC_FEATURE (41)..(41): X is F, W, or Y
  MISC_FEATURE (42)..(42): X is R, H, or K
  MISC_FEATURE (44)..(44): X is S, T, N, or Q
  MISC_FEATURE (45)..(45): X is A, C, G, P, M, V, I, L, Sce or Sme
  MISC_FEATURE (50)..(50): X is D or E
  MISC_FEATURE (52)..(52): X is D or E
  MISC_FEATURE (54)..(57): X is A, C, G, P, M, V, I, L, Sce or Sme
  MISC_FEATURE (58)..(58): X is R, H, or K
  MISC_FEATURE (59)..(61): X is S, T, N, or Q
  MISC_FEATURE (62)..(62): X is R, H, or K
  MISC_FEATURE (63)..(63): X is A, C, G, P, M, V, I, L, Sce or Sme
  MISC_FEATURE (64)..(64): X is F, W, or Y
  MISC_FEATURE (65)..(65): X is A, C, G, P, M, V, I, L, Sce or Sme
  MISC_FEATURE (66)..(66): X is R, H, or K
  MISC_FEATURE (67)..(67): X is A, C, G, P, M, V, I, L, Sce or Sme
  MISC_FEATURE (68)..(68): X is R, H, or K
  MISC_FEATURE (69)..(69): X is D or E
  MISC_FEATURE (70)..(70): X is R, H, or K
  MISC_FEATURE (71)..(71): X is A, C, G, P, M, V, I, L, Sce or Sme
  MISC_FEATURE (72)..(72): X is R, H, or K
  MISC_FEATURE (73)..(74): X is A, C, G, P, M, V, I, L, Sce or Sme
  MISC_FEATURE (75)..(75): X is R, H, or K
  MISC_FEATURE (76)..(76): X is A, C, G, P, M, V, I, L, Sce or Sme
  MISC_FEATURE (77)..(77): X is F, W, or Y
  MISC_FEATURE (78)..(78): X is S, T, N, or Q
  MISC_FEATURE (79)..(80): X is A, C, G, P, M, V, I, L, Sce or Sme
  MISC_FEATURE (81)..(81): X is D or E
  MISC_FEATURE (82)..(88): X is A, C, G, P, M, V, I, L, Sce or Sme
  MISC_FEATURE (89)..(89): X is D or E
  MISC_FEATURE (90)..(90): X is A, C, G, P, M, V, I, L, Sce or Sme
  MISC_FEATURE (91)..(91): X is S, T, N, or Q
  MISC_FEATURE (92)..(92): X is R, H, or K
  MISC_FEATURE (93)..(93): X is D or E
  MISC_FEATURE (94)..(94): X is F, W, or Y
  MISC_FEATURE (95)..(95): X is A, C, G, P, M, V, I, L, Sce or Sme
  MISC_FEATURE (96)..(96): X is D or E
  MISC_FEATURE (97)..(97): X is F, W, or Y
  MISC_FEATURE (98)..(98): X is A, C, G, P, M, V, I, L, Sce or Sme
  MISC_FEATURE (99)..(99): X is R, H, or K
  MISC_FEATURE (100)..(100): X is D or E
  MISC_FEATURE (101)..(102): X is S, T, N, or Q
  MISC_FEATURE (103)..(103): X is A, C, G, P, M, V, I, L, Sce or Sme

SEQ ID NO: 35 - protein, 122 aa, Artificial Sequence; identical to SEQ ID NO: 25
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H or K
  MISC_FEATURE (4)..(5): Xaa is A, C, G, P, M, V, I, L, Sce, or Sme
  MISC_FEATURE (6)..(6): Xaa is R, H or K
  MISC_FEATURE (7)..(8): Xaa is A, C, G, P, M, V, I, L, Sce, or Sme
  MISC_FEATURE (10)..(119): Xaa is S, T, N, or Q
  MISC_FEATURE (11)..(11): Xaa is A, C, G, P, M, V, I, L, Sce, or Sme
  MISC_FEATURE (14)..(14): Xaa is D or E
  MISC_FEATURE (19)..(19): Xaa is A, C, G, P, M, V, I, L, Sce, or Sme
  MISC_FEATURE (23)..(23): Xaa is S, T, N, or Q
  MISC_FEATURE (26)..(27): Xaa is A, C, G, P, M, V, I, L, Sce, or Sme
  MISC_FEATURE (30)..(31): Xaa is A, C, G, P, M, V, I, L, Sce, or Sme
  MISC_FEATURE (33)..(33): Xaa is A, C, G, P, M, V, I, L, Sce, or Sme
  MISC_FEATURE (34)..(34): Xaa is S, T, N, or Q
  MISC_FEATURE (35)..(36): Xaa is A, C, G, P, M, V, I, L, Sce, or Sme
  MISC_FEATURE (37)..(38): Xaa is S, T, N, or Q
  MISC_FEATURE (39)..(39): Xaa is F, W, or Y
  MISC_FEATURE (40)..(41): Xaa is D or E
  MISC_FEATURE (42)..(46): Xaa is A, C, G, P, M, V, I, L, Sce, or Sme
  MISC_FEATURE (47)..(47): Xaa is F, W, or Y
  MISC_FEATURE (48)..(48): Xaa is S, T, N, or Q
  MISC_FEATURE (49)..(49): Xaa is A, C, G, P, M, V, I, L, Sce, or Sme
  MISC_FEATURE (50)..(50): Xaa is S, T, N, or Q
  MISC_FEATURE (51)..(52): Xaa is D or E
  MISC_FEATURE (53)..(53): Xaa is A, C, G, P, M, V, I, L, Sce, or Sme
  MISC_FEATURE (54)..(55): Xaa is S, T, N, or Q
  MISC_FEATURE (56)..(56): Xaa is A, C, G, P, M, V, I, L, Sce, or Sme
  MISC_FEATURE (57)..(57): Xaa is F, W, or Y
  MISC_FEATURE (58)..(59): Xaa is A, C, G, P, M, V, I, L, Sce, or Sme
  MISC_FEATURE (62)..(62): Xaa is A, C, G, P, M, V, I, L, Sce, or Sme
  MISC_FEATURE (63)..(63): Xaa is R, H or K
  MISC_FEATURE (66)..(67): Xaa is A, C, G, P, M, V, I, L, Sce, or Sme
  MISC_FEATURE (69)..(69): Xaa is R, H or K
  MISC_FEATURE (70)..(73): Xaa is A, C, G, P, M, V, I, L, Sce, or Sme
  MISC_FEATURE (74)..(74): Xaa is S, T, N, or Q
  MISC_FEATURE (75)..(75): Xaa is A, C, G, P, M, V, I, L, Sce, or Sme
  MISC_FEATURE (76)..(76): Xaa is R, H or K
  MISC_FEATURE (77)..(77): Xaa is D or E
  MISC_FEATURE (78)..(82): Xaa is A, C, G, P, M, V, I, L, Sce, or Sme
  MISC_FEATURE (83)..(83): Xaa is S, T, N, or Q
  MISC_FEATURE (84)..(85): Xaa is A, C, G, P, M, V, I, L, Sce, or Sme
  MISC_FEATURE (86)..(86): Xaa is R, H or K
  MISC_FEATURE (87)..(88): Xaa is A, C, G, P, M, V, I, L, Sce, or Sme
  MISC_FEATURE (89)..(89): Xaa is R, H or K
  MISC_FEATURE (90)..(93): Xaa is A, C, G, P, M, V, I, L, Sce, or Sme
  MISC_FEATURE (94)..(94): Xaa is F, W, or Y
  MISC_FEATURE (95)..(96): Xaa is S, T, N, or Q
  MISC_FEATURE (97)..(97): Xaa is D or E
  MISC_FEATURE (98)..(98): Xaa is S, T, N, or Q
  MISC_FEATURE (99)..(99): Xaa is A, C, G, P, M, V, I, L, Sce, or Sme
  MISC_FEATURE (100)..(100): Xaa is S, T, N, or Q
  MISC_FEATURE (101)..(101): Xaa is D or E
  MISC_FEATURE (102)..(102): Xaa is R, H or K
  MISC_FEATURE (103)..(103): Xaa is A, C, G, P, M, V, I, L, Sce, or Sme
  MISC_FEATURE (104)..(105): Xaa is R, H or K
  MISC_FEATURE (106)..(106): Xaa is A, C, G, P, M, V, I, L, Sce, or Sme
  MISC_FEATURE (107)..(107): Xaa is F, W, or Y
  MISC_FEATURE (108)..(108): Xaa is A, C, G, P, M, V, I, L, Sce, or Sme
  MISC_FEATURE (110)..(110): Xaa is D or E
  MISC_FEATURE (111)..(112): Xaa is A, C, G, P, M, V, I, L, Sce, or Sme
  MISC_FEATURE (113)..(113): Xaa is R, H or K
  MISC_FEATURE (114)..(114): Xaa is A, C, G, P, M, V, I, L, Sce, or Sme
  MISC_FEATURE (115)..(115): Xaa is R, H or K
  MISC_FEATURE (116)..(116): Xaa is A, C, G, P, M, V, I, L, Sce, or Sme
  MISC_FEATURE (117)..(117): Xaa is D or E
  MISC_FEATURE (118)..(118): Xaa is A, C, G, P, M, V, I, L, Sce, or Sme
  MISC_FEATURE (119)..(119): Xaa is D or E
  MISC_FEATURE (120)..(120): Xaa is S, T, N, or Q
  MISC_FEATURE (121)..(121): Xaa is A, C, G, P, M, V, I, L, Sce, or Sme
  MISC_FEATURE (122)..(122): Xaa is S, T, N, or Q

SEQ ID NO: 36 - protein, 177 aa, Artificial Sequence; identical to SEQ ID NO: 26
  Synthetic
  MISC_FEATURE (1)..(1): Xaa is any amino acid or is optionally absent
  MISC_FEATURE (2)..(2): Xaa is S, T, N or Q
  MISC_FEATURE (3)..(3): Xaa is R, H, or K
  MISC_FEATURE (4)..(4): Xaa is A, C, G, P, M, V, I, L, Selenomethionine (Sme), or Selenocysteine (Sce)
  MISC_FEATURE (5)..(5): Xaa is R, H, or K
  MISC_FEATURE (6)..(9): Xaa is A, C, G, P, M, V, I, L, Sce, or Sme
  MISC_FEATURE (10)..(10): Xaa is S, T, N or Q
  MISC_FEATURE (11)..(11): Xaa is A, C, G, P, M, V, I, L, Sce, or Sme
  MISC_FEATURE (12)..(12): Xaa is S, T, N or Q
  MISC_FEATURE (13)..(13): Xaa is D or E
  MISC_FEATURE (14)..(14): Xaa is R, H, or K
  MISC_FEATURE (15)..(15): Xaa is A, C, G, P, M, V, I, L, Sce, or Sme
  MISC_FEATURE (16)..(16): Xaa is S, T, N or Q
  MISC_FEATURE (17)..(19): Xaa is A, C, G, P, M, V, I, L, Sce, or Sme
  MISC_FEATURE (20)..(20): Xaa is S, T, N or Q
  MISC_FEATURE (21)..(21): Xaa is A, C, G, P, M, V, I, L, Sce, or Sme
  MISC_FEATURE (22)..(22): Xaa is D or E
  MISC_FEATURE (24)..(24): Xaa is S, T, N or Q
  MISC_FEATURE (25)..(25): Xaa is A, C, G, P, M, V, I, L, Sce, or Sme
  MISC_FEATURE (28)..(29): Xaa is A, C, G, P, M, V, I, L, Sce, or Sme
  MISC_FEATURE (32)..(32): Xaa is A, C, G, P, M, V, I, L, Sce, or Sme
  MISC_FEATURE (36)..(36): Xaa is A, C, G, P, M, V, I, L, Sce, or Sme
  MISC_FEATURE (37)..(38): Xaa is S, T, N or Q
  MISC_FEATURE (39)..(39): Xaa is D or E
  MISC_FEATURE (40)..(40): Xaa is F, W, or Y
  MISC_FEATURE (41)..(41): Xaa is D or E
  MISC_FEATURE (42)..(43): Xaa is A, C, G, P, M, V, I, L, Sce, or Sme
  MISC_FEATURE (44)..(44): Xaa is F, W, or Y
  MISC_FEATURE (45)..(45): Xaa is S, T, N or Q
  MISC_FEATURE (46)..(48): Xaa is A, C, G, P, M, V, I, L, Sce, or Sme
  MISC_FEATURE (49)..(50): Xaa is D or E
  MISC_FEATURE (51)..(51): Xaa is S, T, N or Q
  MISC_FEATURE (52)..(52): Xaa is D or E
  MISC_FEATURE (53)..(54): Xaa is A, C, G, P, M, V, I, L, Sce, or Sme
  MISC_FEATURE (55)..(55): Xaa is D or E
  MISC_FEATURE (56)..(57): Xaa is S, T, N or Q
  MISC_FEATURE (58)..(59): Xaa is A, C, G, P, M, V, I, L, Sce, or Sme
  MISC_FEATURE (60)..(60): Xaa is R, H, or K
  MISC_FEATURE (61)..(62): Xaa is A, C, G, P, M, V, I, L, Sce, or Sme
  MISC_FEATURE (63)..(64): Xaa is D or E
  MISC_FEATURE (65)..(65): Xaa is S, T, N or Q
  MISC_FEATURE (66)..(66): Xaa is D or E
  MISC_FEATURE (67)..(71): Xaa is A, C, G, P, M, V, I, L, Sce, or Sme
  MISC_FEATURE (72)..(73): Xaa is S, T, N or Q
  MISC_FEATURE (74)..(75): Xaa is A, C, G, P, M, V, I, L, Sce, or Sme
  MISC_FEATURE (76)..(76): Xaa is S, T, N or Q
  MISC_FEATURE (77)..(79): Xaa is A, C, G, P, M, V, I, L, Sce, or Sme
  MISC_FEATURE (80)..(81): Xaa is R, H, or K
  MISC_FEATURE (82)..(82): Xaa is D or E
  MISC_FEATURE (83)..(83): Xaa is A, C, G, P, M, V, I, L, Sce, or Sme
  MISC_FEATURE (84)..(84): Xaa is S, T, N or Q
  MISC_FEATURE (85)..(85): Xaa is A, C, G, P, M, V, I, L, Sce, or Sme
  MISC_FEATURE (86)..(86): Xaa is D or E
  MISC_FEATURE (87)..(87): Xaa is A, C, G, P, M, V, I, L, Sce, or Sme
  MISC_FEATURE (88)..(88): Xaa is S, T, N or Q
  MISC_FEATURE (89)..(89): Xaa is D or E
  MISC_FEATURE (90)..(92): Xaa is A, C, G, P, M, V, I, L, Sce, or Sme
  MISC_FEATURE (93)..(93): Xaa is D or E
  MISC_FEATURE (94)..(94): Xaa is R, H, or K
  MISC_FEATURE (95)..(98): Xaa is A, C, G, P, M, V, I, L, Sce, or Sme
  MISC_FEATURE (99)..(99): Xaa is F, W, or Y
  MISC_FEATURE (100)..(100): Xaa is A, C, G, P, M, V, I, L, Sce, or Sme
  MISC_FEATURE (101)..(101): Xaa is D or E
  MISC_FEATURE (102)..(103): Xaa is A, C, G, P, M, V, I, L, Sce, or Sme
  MISC_FEATURE (104)..(104): Xaa is R, H, or K
  MISC_FEATURE (105)..(105): Xaa is A, C, G, P, M, V, I, L, Sce, or Sme
  MISC_FEATURE (106)..(106): Xaa is D or E
  MISC_FEATURE (107)..(107): Xaa is S, T, N or Q
  MISC_FEATURE (108)..(108): Xaa is A, C, G, P, M, V, I, L, Sce, or Sme
  MISC_FEATURE (109)..(109): Xaa is R, H, or K
  MISC_FEATURE (110)..(110): Xaa is D or E
  MISC_FEATURE (111)..(112): Xaa is A, C, G, P, M, V, I, L, Sce, or Sme
  MISC_FEATURE (113)..(113): Xaa is S, T, N or Q
  MISC_FEATURE (114)..(116): Xaa is A, C, G, P, M, V, I, L, Sce, or Sme
  MISC_FEATURE (117)..(117): Xaa is S, T, N or Q
  MISC_FEATURE (118)..(118): Xaa is R, H, or K
  MISC_FEATURE (119)..(120): Xaa is S, T, N or Q
  MISC_FEATURE (121)..(123): Xaa is A, C, G, P, M, V, I, L, Sce, or Sme
  MISC_FEATURE (124)..(124): Xaa is R, H, or K
  MISC_FEATURE (125)..(125): Xaa is A, C, G, P, M, V, I, L, Sce, or Sme
  MISC_FEATURE (126)..(126): Xaa is D or E
  MISC_FEATURE (127)..(127): Xaa is S, T, N or Q
  MISC_FEATURE (128)..(130): Xaa is A, C, G, P, M, V, I, L, Sce, or Sme
  MISC_FEATURE (131)..(131): Xaa is S, T, N or Q
  MISC_FEATURE (132)..(134): Xaa is A, C, G, P, M, V, I, L, Sce, or Sme
  MISC_FEATURE (135)..(135): Xaa is D or E
  MISC_FEATURE (136)..(136): Xaa is A, C, G, P, M, V, I, L, Sce, or Sme
  MISC_FEATURE (139)..(139): Xaa is A, C, G, P, M, V, I, L, Sce, or Sme
  MISC_FEATURE (142)..(143): Xaa is A, C, G, P, M, V, I, L, Sce, or Sme
  MISC_FEATURE (145)..(146): Xaa is A, C, G, P, M, V, I, L, Sce, or Sme
  MISC_FEATURE (147)..(147): Xaa is F, W, or Y
  MISC_FEATURE (148)..(151): Xaa is A, C, G, P, M, V, I, L, Sce, or Sme
  MISC_FEATURE (152)..(152): Xaa is F, W, or Y
  MISC_FEATURE (153)..(154): Xaa is A, C, G, P, M, V, I, L, Sce, or Sme
  MISC_FEATURE (155)..(155): Xaa is D or E
  MISC_FEATURE (156)..(157): Xaa is A, C, G, P, M, V, I, L, Sce, or Sme
  MISC_FEATURE (158)..(158): Xaa is D or E
  MISC_FEATURE (159)..(160): Xaa is A, C, G, P, M, V, I, L, Sce, or Sme
  MISC_FEATURE (161)..(161): Xaa is F, W, or Y
  MISC_FEATURE (162)..(162): Xaa is A, C, G, P, M, V, I, L, Sce, or Sme
  MISC_FEATURE (163)..(163): Xaa is D or E
  MISC_FEATURE (164)..(164): Xaa is A, C, G, P, M, V, I, L, Sce, or Sme
  MISC_FEATURE (165)..(165): Xaa is S, T, N or Q
  MISC_FEATURE (166)..(166): Xaa is D or E
  MISC_FEATURE (169)..(169): Xaa is A, C, G, P, M, V, I, L, Sce, or Sme
  MISC_FEATURE (170)..(170): Xaa is R, H, or K
  MISC_FEATURE (171)..(171): Xaa is A, C, G, P, M, V, I, L, Sce, or Sme
  MISC_FEATURE (172)..(172): Xaa is F, W, or Y
  MISC_FEATURE (173)..(173): Xaa is R, H, or K
  MISC_FEATURE (174)..(174): Xaa is A, C, G, P, M, V, I, L, Sce, or Sme
  MISC_FEATURE (175)..(175): Xaa is R, H, or K
  MISC_FEATURE (176)..(176): Xaa is A, C, G, P, M, V, I, L, Sce, or Sme
  MISC_FEATURE (177)..(177): Xaa is R, H, or K

SEQ ID NO: 37 - protein, 122 aa, Artificial Sequence; identical to SEQ ID NO: 27
  Synthetic
  MISC_FEATURE (1)..(1): Xaa is any amino acid or optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(5): Xaa is A, C, G, P, M, V, I, L, Sce, or Sme
  MISC_FEATURE (6)..(6): Xaa is R, H, or K
  MISC_FEATURE (7)..(9): Xaa is A, C, G, P, M, V, I, L, Sce, or Sme
  MISC_FEATURE (10)..(10): Xaa is S, T, N or Q
  MISC_FEATURE (11)..(11): Xaa is A, C, G, P, M, V, I, L, Sce, or Sme
  MISC_FEATURE (14)..(14): Xaa is D or E
  MISC_FEATURE (19)..(19): Xaa is A, C, G, P, M, V, I, L, Sce, or Sme
  MISC_FEATURE (22)..(22): Xaa is A, C, G, P, M, V, I, L, Sce, or Sme
  MISC_FEATURE (23)..(23): Xaa is S, T, N or Q
  MISC_FEATURE (26)..(27): Xaa is A, C, G, P, M, V, I, L, Sce, or Sme
  MISC_FEATURE (29)..(29): Xaa is R, H, or K
  MISC_FEATURE (30)..(31): Xaa is A, C, G, P, M, V, I, L, Sce, or Sme
  MISC_FEATURE (32)..(32): Xaa is D or E
  MISC_FEATURE (33)..(33): Xaa is A, C, G, P, M, V, I, L, Sce, or Sme
  MISC_FEATURE (34)..(34): Xaa is S, T, N or Q
  MISC_FEATURE (35)..(36): Xaa is A, C, G, P, M, V, I, L, Sce, or Sme
  MISC_FEATURE (37)..(38): Xaa is S, T, N or Q
  MISC_FEATURE (39)..(39): Xaa is F, W or Y
  MISC_FEATURE (40)..(41): Xaa is D or E
  MISC_FEATURE (42)..(46): Xaa is A, C, G, P, M, V, I, L, Sce, or Sme
  MISC_FEATURE (47)..(47): Xaa is F, W or Y
  MISC_FEATURE (48)..(48): Xaa is S, T, N or Q
  MISC_FEATURE (49)..(49): Xaa is A, C, G, P, M, V, I, L, Sce, or Sme
  MISC_FEATURE (50)..(50): Xaa is S, T, N or Q
  MISC_FEATURE (51)..(52): Xaa is D or E
  MISC_FEATURE (53)..(53): Xaa is A, C, G, P, M, V, I, L, Sce, or Sme
  MISC_FEATURE (54)..(55): Xaa is S, T, N or Q
  MISC_FEATURE (56)..(56): Xaa is A, C, G, P, M, V, I, L, Sce, or Sme
  MISC_FEATURE (57)..(57): Xaa is F, W or Y
  MISC_FEATURE (58)..(59): Xaa is A, C, G, P, M, V, I, L, Sce, or Sme
  MISC_FEATURE (60)..(60): Xaa is D or E
  MISC_FEATURE (61)..(62): Xaa is A, C, G, P, M, V, I, L, Sce, or Sme
  MISC_FEATURE (63)..(63): Xaa is R, H, or K
  MISC_FEATURE (65)..(67): Xaa is A, C, G, P, M, V, I, L, Sce, or Sme
  MISC_FEATURE (68)..(69): Xaa is R, H, or K
  MISC_FEATURE (70)..(73): Xaa is A, C, G, P, M, V, I, L, Sce, or Sme
  MISC_FEATURE (74)..(74): Xaa is S, T, N or Q
  MISC_FEATURE (75)..(75): Xaa is A, C, G, P, M, V, I, L, Sce, or Sme
  MISC_FEATURE (76)..(76): Xaa is R, H, or K
  MISC_FEATURE (77)..(77): Xaa is D or E
  MISC_FEATURE (78)..(82): Xaa is A, C, G, P, M, V, I, L, Sce, or Sme
  MISC_FEATURE (83)..(83): Xaa is S, T, N or Q
  MISC_FEATURE (84)..(85): Xaa is A, C, G, P, M, V, I, L, Sce, or Sme
  MISC_FEATURE (86)..(86): Xaa is R, H, or K
  MISC_FEATURE (87)..(88): Xaa is A, C, G, P, M, V, I, L, Sce, or Sme
  MISC_FEATURE (89)..(89): Xaa is R, H, or K
  MISC_FEATURE (90)..(93): Xaa is A, C, G, P, M, V, I, L, Sce, or Sme
  MISC_FEATURE (94)..(94): Xaa is F, W or Y
  MISC_FEATURE (95)..(96): Xaa is S, T, N or Q
  MISC_FEATURE (97)..(97): Xaa is D or E
  MISC_FEATURE (98)..(98): Xaa is S, T, N or Q
  MISC_FEATURE (99)..(99): Xaa is A, C, G, P, M, V, I, L, Sce, or Sme
  MISC_FEATURE (100)..(100): Xaa is S, T, N or Q
  MISC_FEATURE (101)..(101): Xaa is D or E
  MISC_FEATURE (102)..(102): Xaa is R, H, or K
  MISC_FEATURE (103)..(103): Xaa is A, C, G, P, M, V, I, L, Sce, or Sme
  MISC_FEATURE (104)..(105): Xaa is R, H, or K
  MISC_FEATURE (106)..(106): Xaa is A, C, G, P, M, V, I, L, Sce, or Sme
  MISC_FEATURE (107)..(107): Xaa is F, W or Y
  MISC_FEATURE (108)..(108): Xaa is A, C, G, P, M, V, I, L, Sce, or Sme
  MISC_FEATURE (110)..(110): Xaa is D or E
  MISC_FEATURE (111)..(112): Xaa is A, C, G, P, M, V, I, L, Sce, or Sme
  MISC_FEATURE (113)..(113): Xaa is R, H, or K
  MISC_FEATURE (114)..(114): Xaa is A, C, G, P, M, V, I, L, Sce, or Sme
  MISC_FEATURE (115)..(115): Xaa is R, H, or K
  MISC_FEATURE (116)..(116): Xaa is A, C, G, P, M, V, I, L, Sce, or Sme
  MISC_FEATURE (117)..(117): Xaa is D or E
  MISC_FEATURE (118)..(118): Xaa is A, C, G, P, M, V, I, L, Sce, or Sme
  MISC_FEATURE (119)..(119): Xaa is D or E
  MISC_FEATURE (120)..(120): Xaa is S, T, N or Q
  MISC_FEATURE (121)..(121): Xaa is A, C, G, P, M, V, I, L, Sce, or Sme
  MISC_FEATURE (122)..(122): Xaa is S, T, N or Q

SEQ ID NO: 38 - protein, 172 aa, Artificial Sequence; identical to SEQ ID NO: 28
  Synthetic
  MISC_FEATURE (1)..(1): Xaa is any amino acid or is optionally absent
  MISC_FEATURE (2)..(2): Xaa is R, H, or K
  MISC_FEATURE (3)..(3): Xaa is A, C, G, P, M, V, I, L, Selenomethionine (Sme), or Selenocysteine (Sce)
  MISC_FEATURE (4)..(5): Xaa is S, T, N or Q
  MISC_FEATURE (6)..(6): Xaa is R, H, or K
  MISC_FEATURE (7)..(8): Xaa is A, C, G, P, M, V, I, L, Sce, or Sme
  MISC_FEATURE (9)..(9): Xaa is D or E
  MISC_FEATURE (10)..(10): Xaa is R, H, or K
  MISC_FEATURE (11)..(11): Xaa is A, C, G, P, M, V, I, L, Sce, or Sme
  MISC_FEATURE (12)..(13): Xaa is S, T, N or Q
  MISC_FEATURE (14)..(14): Xaa is R, H, or K
  MISC_FEATURE (15)..(15): Xaa is A, C, G, P, M, V, I, L, Sce, or Sme
  MISC_FEATURE (16)..(16): Xaa is F, W, or Y
  MISC_FEATURE (17)..(18): Xaa is A, C, G, P, M, V, I, L, Sce, or Sme
  MISC_FEATURE (19)..(20): Xaa is D or E
  MISC_FEATURE (21)..(21): Xaa is A, C, G, P, M, V, I, L, Sce, or Sme
  MISC_FEATURE (22)..(22): Xaa is F, W, or Y
  MISC_FEATURE (24)..(24): Xaa is D or E
  MISC_FEATURE (25)..(25): Xaa is S, T, N or Q
  MISC_FEATURE (26)..(28): Xaa is A, C, G, P, M, V, I, L, Sce, or Sme
  MISC_FEATURE (29)..(29): Xaa is D or E
  MISC_FEATURE (30)..(30): Xaa is A, C, G, P, M, V, I, L, Sce, or Sme
  MISC_FEATURE (31)..(31): Xaa is S, T, N or Q
  MISC_FEATURE (32)..(32): Xaa is A, C, G, P, M, V, I, L, Sce, or Sme
  MISC_FEATURE (33)..(33): Xaa is S, T, N or Q
  MISC_FEATURE (34)..(34): Xaa is A, C, G, P, M, V, I, L, Sce, or Sme
  MISC_FEATURE (35)..(36): Xaa is D or E
  MISC_FEATURE (37)..(37): Xaa is A, C, G, P, M, V, I, L, Sce, or Sme
  MISC_FEATURE (38)..(39): Xaa is S, T, N or Q
  MISC_FEATURE (40)..(40): Xaa is F, W, or Y
  MISC_FEATURE (41)..(42): Xaa is A, C, G, P, M, V, I, L, Sce, or Sme
  MISC_FEATURE (43)..(43): Xaa is D or E
  MISC_FEATURE (44)..(44): Xaa is A, C, G, P, M, V, I, L, Sce, or Sme
  MISC_FEATURE (45)..(46): Xaa is R, H, or K
  MISC_FEATURE (47)..(47): Xaa is F, W, or Y
  MISC_FEATURE (48)..(48): Xaa is A, C, G, P, M, V, I, L, Sce, or Sme
  MISC_FEATURE (49)..(51): Xaa is D or E
  MISC_FEATURE (52)..(52): Xaa is A, C, G, P, M, V, I, L, Sce, or Sme
  MISC_FEATURE (53)..(53): Xaa is R, H, or K
  MISC_FEATURE (54)..(56): Xaa is A, C, G, P, M, V, I, L, Sce, or Sme
  MISC_FEATURE (57)..(58): Xaa is D or E
  MISC_FEATURE (59)..(59): Xaa is A, C, G, P, M, V, I, L, Sce, or Sme
  MISC_FEATURE (60)..(61): Xaa is S, T, N or Q
  MISC_FEATURE (62)..(62): Xaa is D or E
  MISC_FEATURE (63)..(63): Xaa is A, C, G, P, M, V, I, L, Sce, or Sme
  MISC_FEATURE (64)..(64): Xaa is F, W, or Y
  MISC_FEATURE (65)..(65): Xaa is R, H, or K
  MISC_FEATURE (66)..(68): Xaa is A, C, G, P, M, V, I, L, Sce, or Sme
  MISC_FEATURE (69)..(69): Xaa is D or E
  MISC_FEATURE (70)..(71): Xaa is A, C, G, P, M, V, I, L, Sce, or Sme
  MISC_FEATURE (72)..(72): Xaa is S, T, N or Q
  MISC_FEATURE (73)..(73): Xaa is R, H, or K
  MISC_FEATURE (74)..(74): Xaa is A, C, G, P, M, V, I, L, Sce, or Sme
  MISC_FEATURE (75)..(75): Xaa is R, H, or K
  MISC_FEATURE (76)..(76): Xaa is A, C, G, P, M, V, I, L, Sce, or Sme
  MISC_FEATURE (77)..(77): Xaa is D or E
  MISC_FEATURE (78)..(79): Xaa is A, C, G, P, M, V, I, L, Sce, or Sme
  MISC_FEATURE (80)..(80): Xaa is S, T, N or Q
  MISC_FEATURE (82)..(82): Xaa is D or E
  MISC_FEATURE (83)..(83): Xaa is R, H, or K
  MISC_FEATURE (86)..(86): Xaa is F, W, or Y
  MISC_FEATURE (87)..(87): Xaa is A, C, G, P, M, V, I, L, Sce, or Sme
  MISC_FEATURE (89)..(89): Xaa is R, H, or K
  MISC_FEATURE (90)..(90): Xaa is A, C, G, P, M, V, I, L, Sce, or Sme
  MISC_FEATURE (93)..(93): Xaa is R, H, or K
  MISC_FEATURE (94)..(94): Xaa is F, W, or Y
  MISC_FEATURE (96)..(96): Xaa is D or E
  MISC_FEATURE (97)..(98): Xaa is A, C, G, P, M, V, I, L, Sce, or Sme
  MISC_FEATURE (99)..(99): Xaa is S, T, N or Q
  MISC_FEATURE (100)..(100): Xaa is A, C, G, P, M, V, I, L, Sce, or Sme
  MISC_FEATURE (101)..(101): Xaa is R, H, or K
  MISC_FEATURE (102)..(102): Xaa is S, T, N or Q
  MISC_FEATURE (103)..(103): Xaa is F, W, or Y
  MISC_FEATURE (104)..(108): Xaa is A, C, G, P, M, V, I, L, Sce, or Sme
  MISC_FEATURE (109)..(109): Xaa is S, T, N or Q
  MISC_FEATURE (110)..(110): Xaa is A, C, G, P, M, V, I, L, Sce, or Sme
  MISC_FEATURE (111)..(111): Xaa is D or E
  MISC_FEATURE (112)..(112): Xaa is S, T, N or Q
  MISC_FEATURE (113)..(113): Xaa is A, C, G, P, M, V, I, L, Sce, or Sme
  MISC_FEATURE (114)..(114): Xaa is R, H, or K
  MISC_FEATURE (115)..(115): Xaa is A, C, G, P, M, V, I, L, Sce, or Sme
  MISC_FEATURE (116)..(116): Xaa is D or E
  MISC_FEATURE (117)..(118): Xaa is A, C, G, P, M, V, I, L, Sce, or Sme
  MISC_FEATURE (119)..(119): Xaa is R, H, or K
  MISC_FEATURE (120)..(120): Xaa is S, T, N or Q
  MISC_FEATURE (121)..(122): Xaa is A, C, G, P, M, V, I, L, Sce, or Sme
  MISC_FEATURE (123)..(124): Xaa is R, H, or K
  MISC_FEATURE (125)..(125): Xaa is A, C, G, P, M, V, I, L, Sce, or Sme
  MISC_FEATURE (127)..(128): Xaa is R, H, or K
  MISC_FEATURE (129)..(129): Xaa is A, C, G, P, M, V, I, L, Sce, or Sme
  MISC_FEATURE (131)..(131): Xaa is S, T, N or Q
  MISC_FEATURE (132)..(132): Xaa is A, C, G, P, M, V, I, L, Sce, or Sme
  MISC_FEATURE (135)..(135): Xaa is D or E
  MISC_FEATURE (136)..(136): Xaa is F, W, or Y
  MISC_FEATURE (139)..(139): Xaa is A, C, G, P, M, V, I, L, Sce, or Sme
  MISC_FEATURE (142)..(142): Xaa is A, C, G, P, M, V, I, L, Sce, or Sme
  MISC_FEATURE (145)..(145): Xaa is F, W, or Y
  MISC_FEATURE (146)..(146): Xaa is A, C, G, P, M, V, I, L, Sce, or Sme
  MISC_FEATURE (149)..(149): Xaa is A, C, G, P, M, V, I, L, Sce, or Sme
  MISC_FEATURE (150)..(150): Xaa is S, T, N or Q
  MISC_FEATURE (152)..(153): Xaa is A, C, G, P, M, V, I, L, Sce, or Sme
  MISC_FEATURE (154)..(154): Xaa is F, W, or Y
  MISC_FEATURE (155)..(157): Xaa is A, C, G, P, M, V, I, L, Sce, or Sme
  MISC_FEATURE (158)..(158): Xaa is R, H, or K
  MISC_FEATURE (159)..(160): Xaa is A, C, G, P, M, V, I, L, Sce, or Sme
  MISC_FEATURE (161)..(161): Xaa is D or E
  MISC_FEATURE (162)..(162): Xaa is A, C, G, P, M, V, I, L, Sce, or Sme
  MISC_FEATURE (163)..(163): Xaa is D or E
  MISC_FEATURE (164)..(164): Xaa is R, H, or K
  MISC_FEATURE (165)..(165): Xaa is S, T, N or Q
  MISC_FEATURE (166)..(166): Xaa is R, H, or K
  MISC_FEATURE (167)..(167): Xaa is A, C, G, P, M, V, I, L, Sce, or Sme
  MISC_FEATURE (168)..(168): Xaa is R, H, or K
  MISC_FEATURE (169)..(169): Xaa is D or E
  MISC_FEATURE (170)..(170): Xaa is A, C, G, P, M, V, I, L, Sce, or Sme
  MISC_FEATURE (171)..(171): Xaa is R, H, or K
  MISC_FEATURE (172)..(172): Xaa is S, T, N or Q

SEQ ID NO: 39 - protein, 123 aa, Artificial Sequence; identical to SEQ ID NO: 29
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(6): Xaa is A, C, G, P, M, V, I, L, Sce or Sme
  MISC_FEATURE (7)..(7): Xaa is D or E
  MISC_FEATURE (8)..(8): Xaa is A, C, G, P, M, V, I, L, Sce or Sme
  MISC_FEATURE (9)..(9): Xaa is S, T, N, or Q
  MISC_FEATURE (10)..(10): Xaa is A, C, G, P, M, V, I, L, Sce or Sme
  MISC_FEATURE (11)..(11): Xaa is S, T, N, or Q
  MISC_FEATURE (12)..(12): Xaa is A, C, G, P, M, V, I, L, Sce or Sme
  MISC_FEATURE (13)..(13): Xaa is R, H, or K
  MISC_FEATURE (14)..(14): Xaa is A, C, G, P, M, V, I, L, Sce or Sme
  MISC_FEATURE (15)..(15): Xaa is D or E
  MISC_FEATURE (16)..(17): Xaa is S, T, N, or Q
  MISC_FEATURE (18)..(19): Xaa is A, C, G, P, M, V, I, L, Sce or Sme
  MISC_FEATURE (20)..(20): Xaa is D or E
  MISC_FEATURE (21)..(22): Xaa is A, C, G, P, M, V, I, L, Sce or Sme
  MISC_FEATURE (23)..(23): Xaa is D or E
  MISC_FEATURE (24)..(24): Xaa is S, T, N, or Q
  MISC_FEATURE (25)..(25): Xaa is A, C, G, P, M, V, I, L, Sce or Sme
  MISC_FEATURE (26)..(26): Xaa is S, T, N, or Q
  MISC_FEATURE (27)..(27): Xaa is D or E
  MISC_FEATURE (29)..(29): Xaa is A, C, G, P, M, V, I, L, Sce or Sme
  MISC_FEATURE (33)..(33): Xaa is A, C, G, P, M, V, I, L, Sce or Sme
  MISC_FEATURE (35)..(35): Xaa is F, W, or Y
  MISC_FEATURE (36)..(36): Xaa is A, C, G, P, M, V, I, L, Sce or Sme
  MISC_FEATURE (37)..(37): Xaa is D or E
  MISC_FEATURE (38)..(38): Xaa is A, C, G, P, M, V, I, L, Sce or Sme
  MISC_FEATURE (39)..(39): Xaa is D or E
  MISC_FEATURE (40)..(40): Xaa is A, C, G, P, M, V, I, L, Sce or Sme
  MISC_FEATURE (41)..(41): Xaa is R, H, or K
  MISC_FEATURE (42)..(42): Xaa is S, T, N, or Q
  MISC_FEATURE (43)..(43): Xaa is R, H, or K
  MISC_FEATURE (44)..(44): Xaa is F, W, or Y
  MISC_FEATURE (45)..(45): Xaa is A, C, G, P, M, V, I, L, Sce or Sme
  MISC_FEATURE (46)..(46): Xaa is S, T, N, or Q
  MISC_FEATURE (47)..(47): Xaa is A, C, G, P, M, V, I, L, Sce or Sme
  MISC_FEATURE (48)..(48): Xaa is D or E
  MISC_FEATURE (49)..(49): Xaa is A, C, G, P, M, V, I, L, Sce or Sme
  MISC_FEATURE (50)..(50): Xaa is F, W, or Y
  MISC_FEATURE (51)..(51): Xaa is R, H, or K
  MISC_FEATURE (52)..(52): Xaa is S, T, N, or Q
  MISC_FEATURE (53)..(53): Xaa is A, C, G, P, M, V, I, L, Sce or Sme
  MISC_FEATURE (54)..(54): Xaa is S, T, N, or Q
  MISC_FEATURE (55)..(57): Xaa is A, C, G, P, M, V, I, L, Sce or Sme
  MISC_FEATURE (58)..(58): Xaa is D or E
  MISC_FEATURE (59)..(59): Xaa is R, H, or K
  MISC_FEATURE (60)..(60): Xaa is A, C, G, P, M, V, I, L, Sce or Sme
  MISC_FEATURE (61)..(61): Xaa is F, W, or Y
  MISC_FEATURE (62)..(62): Xaa is A, C, G, P, M, V, I, L, Sce or Sme
  MISC_FEATURE (63)..(63): Xaa is R, H, or K
  MISC_FEATURE (64)..(66): Xaa is A, C, G, P, M, V, I, L, Sce or Sme
  MISC_FEATURE (67)..(67): Xaa is S, T, N, or Q
  MISC_FEATURE (68)..(69): Xaa is A, C, G, P, M, V, I, L, Sce or Sme
  MISC_FEATURE (70)..(70): Xaa is D or E
  MISC_FEATURE (72)..(72): Xaa is R, H, or K
  MISC_FEATURE (77)..(77): Xaa is R, H, or K
  MISC_FEATURE (80)..(81): Xaa is A, C, G, P, M, V, I, L, Sce or Sme
  MISC_FEATURE (84)..(84): Xaa is A, C, G, P, M, V, I, L, Sce or Sme
  MISC_FEATURE (87)..(89): Xaa is A, C, G, P, M, V, I, L, Sce or Sme
  MISC_FEATURE (90)..(90): Xaa is D or E
  MISC_FEATURE (91)..(96): Xaa is A, C, G, P, M, V, I, L, Sce or Sme
  MISC_FEATURE (97)..(98): Xaa is D or E
  MISC_FEATURE (99)..(100): Xaa is A, C, G, P, M, V, I, L, Sce or Sme
  MISC_FEATURE (101)..(101): Xaa is S, T, N, or Q
  MISC_FEATURE (102)..(102): Xaa is A, C, G, P, M, V, I, L, Sce or Sme
  MISC_FEATURE (103)..(103): Xaa is S, T, N, or Q
  MISC_FEATURE (104)..(104): Xaa is A, C, G, P, M, V, I, L, Sce or Sme
  MISC_FEATURE (105)..(105): Xaa is D or E
  MISC_FEATURE (106)..(106): Xaa is A, C, G, P, M, V, I, L, Sce or Sme
  MISC_FEATURE (107)..(107): Xaa is R, H, or K
  MISC_FEATURE (108)..(108): Xaa is D or E
  MISC_FEATURE (109)..(109): Xaa is A, C, G, P, M, V, I, L, Sce or Sme
  MISC_FEATURE (110)..(110): Xaa is D or E
  MISC_FEATURE (111)..(111): Xaa is R, H, or K
  MISC_FEATURE (113)..(113): Xaa is S, T, N, or Q
  MISC_FEATURE (118)..(120): Xaa is A, C, G, P, M, V, I, L, Sce or Sme
  MISC_FEATURE (121)..(121): Xaa is R, H, or K
  MISC_FEATURE (122)..(122): Xaa is S, T, N, or Q
  MISC_FEATURE (123)..(123): Xaa is R, H, or K

SEQ ID NO: 40 - protein, 158 aa, Artificial Sequence; identical to SEQ ID NO: 30
  Synthetic
  MISC_FEATURE (1)..(1): Xaa is any amino acid or is optionally absent
  MISC_FEATURE (2)..(2): Xaa is D or E
  MISC_FEATURE (3)..(3): Xaa is S, T, N or Q
  MISC_FEATURE (4)..(4): Xaa is A, C, G, P, M, V, I, L, Selenomethionine (Sme), or Selenocysteine (Sce)
  MISC_FEATURE (5)..(7): Xaa is S, T, N or Q
  MISC_FEATURE (8)..(8): Xaa is F, W, or Y
  MISC_FEATURE (9)..(9): Xaa is A, C, G, P, M, V, I, L, Sce or Sme
  MISC_FEATURE (10)..(10): Xaa is S, T, N or Q
  MISC_FEATURE (11)..(11): Xaa is A, C, G, P, M, V, I, L, Sce or Sme
  MISC_FEATURE (12)..(12): Xaa is S, T, N or Q
  MISC_FEATURE (13)..(14): Xaa is A, C, G, P, M, V, I, L, Sce or Sme
  MISC_FEATURE (15)..(15): Xaa is S, T, N or Q
  MISC_FEATURE (16)..(16): Xaa is A, C, G, P, M, V, I, L, Sce or Sme
  MISC_FEATURE (17)..(17): Xaa is R, H, or K
  MISC_FEATURE (18)..(18): Xaa is D or E
  MISC_FEATURE (19)..(19): Xaa is F, W, or Y
  MISC_FEATURE (20)..(20): Xaa is D or E
  MISC_FEATURE (21)..(21): Xaa is S, T, N or Q
  MISC_FEATURE (22)..(22): Xaa is A, C, G, P, M, V, I, L, Sce or Sme
  MISC_FEATURE (23)..(23): Xaa is S, T, N or Q
  MISC_FEATURE (24)..(24): Xaa is F, W, or Y
  MISC_FEATURE (25)..(27): Xaa is A, C, G, P, M, V, I, L, Sce or Sme
  MISC_FEATURE (28)..(28): Xaa is R, H, or K
  MISC_FEATURE (29)..(30): Xaa is A, C, G, P, M, V, I, L, Sce or Sme
  MISC_FEATURE (31)..(31): Xaa is R, H, or K
  MISC_FEATURE (32)..(32): Xaa is S, T, N or Q
  MISC_FEATURE (33)..(33): Xaa is A, C, G, P, M, V, I, L, Sce or Sme
  MISC_FEATURE (34)..(34): Xaa is F, W, or Y
  MISC_FEATURE (35)..(36): Xaa is A, C, G, P, M, V, I, L, Sce or Sme
  MISC_FEATURE (37)..(37): Xaa is D or E
  MISC_FEATURE (38)..(38): Xaa is R, H, or K
  MISC_FEATURE (39)..(39): Xaa is A, C, G, P, M, V, I, L, Sce or Sme
  MISC_FEATURE (40)..(40): Xaa is D or E
  MISC_FEATURE (41)..(41): Xaa is A, C, G, P, M, V, I, L, Sce or Sme
  MISC_FEATURE (42)..(42): Xaa is D or E
  MISC_FEATURE (43)..(45): Xaa is A, C, G, P, M, V, I, L, Sce or Sme
  MISC_FEATURE (46)..(46): Xaa is D or E
  MISC_FEATURE (47)..(47): Xaa is R, H, or K
  MISC_FEATURE (48)..(48): Xaa is A, C, G, P, M, V, I, L, Sce or Sme
  MISC_FEATURE (51)..(51): Xaa is A, C, G, P, M, V, I, L, Sce or Sme
  MISC_FEATURE (55)..(55): Xaa is S, T, N or Q
  MISC_FEATURE (58)..(59): Xaa is A, C, G, P, M, V, I, L, Sce or Sme
  MISC_FEATURE (61)..(61): Xaa is D or E
  MISC_FEATURE (62)..(62): Xaa is S, T, N or Q
  MISC_FEATURE (63)..(64): Xaa is D or E
  MISC_FEATURE (65)..(65): Xaa is A, C, G, P, M, V, I, L, Sce or Sme
  MISC_FEATURE (66)..(66): Xaa is F, W, or Y
  MISC_FEATURE (67)..(67): Xaa is R, H, or K
  MISC_FEATURE (68)..(69): Xaa is A, C, G, P, M, V, I, L, Sce or Sme
  MISC_FEATURE (70)..(70): Xaa is R, H, or K
  MISC_FEATURE (71)..(71): Xaa is A, C, G, P, M, V, I, L, Sce or Sme
  MISC_FEATURE (72)..(72): Xaa is R, H, or K
  MISC_FEATURE (73)..(73): Xaa is A, C, G, P, M, V, I, L, Sce or Sme
  MISC_FEATURE (74)..(74): Xaa is R, H, or K
  MISC_FEATURE (75)..(76): Xaa is A, C, G, P, M, V, I, L, Sce or Sme
  MISC_FEATURE (77)..(77): Xaa is D or E
  MISC_FEATURE (78)..(78): Xaa is A, C, G, P, M, V, I, L, Sce or Sme
  MISC_FEATURE (79)..(79): Xaa is D or E
  MISC_FEATURE (80)..(80): Xaa is D or E
  MISC_FEATURE (81)..(82): Xaa is R, H, or K
  MISC_FEATURE (83)..(83): Xaa is S, T, N or Q
  MISC_FEATURE (84)..(84): Xaa is F, W, or Y
  MISC_FEATURE (85)..(85): Xaa is S, T, N or Q
  MISC_FEATURE (86)..(88): Xaa is A, C, G, P, M, V, I, L, Sce or Sme
  MISC_FEATURE (89)..(89): Xaa is F, W, or Y
  MISC_FEATURE (90)..(90): Xaa is A, C, G, P, M, V, I, L, Sce or Sme
  MISC_FEATURE (91)..(91): Xaa is D or E
  MISC_FEATURE (92)..(95): Xaa is A, C, G, P, M, V, I, L, Sce or Sme
  MISC_FEATURE (96)..(96): Xaa is S, T, N or Q
  MISC_FEATURE (97)..(98): Xaa is A, C, G, P, M, V, I, L, Sce or Sme
  MISC_FEATURE (99)..(99): Xaa is S, T, N or Q
  MISC_FEATURE (100)..(100): Xaa is D or E
  MISC_FEATURE (101)..(101): Xaa is A, C, G, P, M, V, I, L, Sce or Sme
  MISC_FEATURE (102)..(102): Xaa is D or E
  MISC_FEATURE (103)..(103): Xaa is R, H, or K
  MISC_FEATURE (104)..(104): Xaa is D or E
  MISC_FEATURE (105)..(105): Xaa is S, T, N or Q
  MISC_FEATURE (106)..(106): Xaa is A, C, G, P, M, V, I, L, Sce or Sme
  MISC_FEATURE (107)..(109): Xaa is D or E
  MISC_FEATURE (110)..(110): Xaa is A, C, G, P, M, V, I, L, Sce or Sme
  MISC_FEATURE (111)..(111): Xaa is R, H, or K
  MISC_FEATURE (114)..(114): Xaa is A, C, G, P, M, V, I, L, Sce or Sme
  MISC_FEATURE (115)..(115): Xaa is R, H, or K
  MISC_FEATURE (118)..(118): Xaa is A, C, G, P, M, V, I, L, Sce or Sme
  MISC_FEATURE (120)..(120): Xaa is A, C, G, P, M, V, I, L, Sce or Sme
  MISC_FEATURE (121)..(121): Xaa is D or E
  MISC_FEATURE (122)..(123): Xaa is A, C, G, P, M, V, I, L, Sce or Sme
  MISC_FEATURE (124)..(125): Xaa is D or E
  MISC_FEATURE (126)..(126): Xaa is R, H, or K
  MISC_FEATURE (127)..(127): Xaa is S, T, N or Q
  MISC_FEATURE (128)..(129): Xaa is A, C, G, P, M, V, I, L, Sce or Sme
  MISC_FEATURE (130)..(131): Xaa is S, T, N or Q
  MISC_FEATURE (132)..(132): Xaa is F, W, or Y
  MISC_FEATURE (133)..(133): Xaa is D or E
  MISC_FEATURE (134)..(134): Xaa is A, C, G, P, M, V, I, L, Sce or Sme
  MISC_FEATURE (135)..(135): Xaa is R, H, or K
  MISC_FEATURE (136)..(136): Xaa is A, C, G, P, M, V, I, L, Sce or Sme
  MISC_FEATURE (137)..(137): Xaa is R, H, or K
  MISC_FEATURE (138)..(139): Xaa is D or E
  MISC_FEATURE (140)..(141): Xaa is A, C, G, P, M, V, I, L, Sce or Sme
  MISC_FEATURE (142)..(143): Xaa is S, T, N or Q
  MISC_FEATURE (144)..(144): Xaa is D or E
  MISC_FEATURE (145)..(145): Xaa is S, T, N or Q
  MISC_FEATURE (146)..(146): Xaa is F, W, or Y
  MISC_FEATURE (147)..(147): Xaa is R, H, or K
  MISC_FEATURE (148)..(148): Xaa is A, C, G, P, M, V, I, L, Sce or Sme
  MISC_FEATURE (149)..(149): Xaa is D or E
  MISC_FEATURE (150)..(150): Xaa is R, H, or K
  MISC_FEATURE (151)..(152): Xaa is D or E
  MISC_FEATURE (153)..(154): Xaa is F, W, or Y
  MISC_FEATURE (155)..(155): Xaa is R, H, or K
  MISC_FEATURE (156)..(156): Xaa is D or E
  MISC_FEATURE (157)..(157): Xaa is F, W, or Y
  MISC_FEATURE (158)..(158): Xaa is A, C, G, P, M, V, I, L, Sce or Sme

SEQ ID NO: 41 - protein, 113 aa, Artificial Sequence; identical to SEQ ID NO: 31
  Synthetic
  MISC_FEATURE (1)..(1): Xaa is any amino acid or is optionally absent
  MISC_FEATURE (2)..(4): Xaa is A, C, G, P, M, V, I, L, Selenomethionine (Sme), or Selenocysteine (Sce)
  MISC_FEATURE (5)..(6): Xaa is S, T, N or Q
  MISC_FEATURE (7)..(7): Xaa is F, W, or Y
  MISC_FEATURE (8)..(8): Xaa is A, C, G, P, M, V, I, L, Sce, or Sme
  MISC_FEATURE (9)..(10): Xaa is S, T, N or Q
  MISC_FEATURE (11)..(12): Xaa is A, C, G, P, M, V, I, L, Sce, or Sme
  MISC_FEATURE (13)..(13): Xaa is D or E
  MISC_FEATURE (14)..(14): Xaa is R, H, or K
  MISC_FEATURE (16)..(17): Xaa is R, H, or K
  MISC_FEATURE (20)..(21): Xaa is A, C, G, P, M, V, I, L, Sce, or Sme
  MISC_FEATURE (24)..(24): Xaa is F, W, or Y
  MISC_FEATURE (28)..(28): Xaa is S, T, N or Q
  MISC_FEATURE (32)..(33): Xaa is A, C, G, P, M, V, I, L, Sce, or Sme
  MISC_FEATURE (34)..(34): Xaa is R, H, or K
  MISC_FEATURE (35)..(35): Xaa is A, C, G, P, M, V, I, L, Sce, or Sme
  MISC_FEATURE (37)..(37): Xaa is D or E
  MISC_FEATURE (38)..(41): Xaa is A, C, G, P, M, V, I, L, Sce, or Sme
  MISC_FEATURE (42)..(42): Xaa is S, T, N or Q
  MISC_FEATURE (43)..(43): Xaa is F, W, or Y
  MISC_FEATURE (44)..(44): Xaa is R, H, or K
  MISC_FEATURE (45)..(45): Xaa is D or E
  MISC_FEATURE (46)..(47): Xaa is S, T, N or Q
  MISC_FEATURE (48)..(49): Xaa is A, C, G, P, M, V, I, L, Sce, or Sme
  MISC_FEATURE (50)..(50): Xaa is R, H, or K
  MISC_FEATURE (51)..(52): Xaa is F, W, or Y
  MISC_FEATURE (53)..(53): Xaa is A, C, G, P, M, V, I, L, Sce, or Sme
  MISC_FEATURE (54)..(55): Xaa is S, T, N or Q
  MISC_FEATURE (56)..(56): Xaa is D or E
  MISC_FEATURE (57)..(61): Xaa is A, C, G, P, M, V, I, L, Sce, or Sme
  MISC_FEATURE (62)..(62): Xaa is R, H, or K
  MISC_FEATURE (63)..(63): Xaa is A, C, G, P, M, V, I, L, Sce, or Sme
  MISC_FEATURE (64)..(64): Xaa is D or E
  MISC_FEATURE (65)..(68): Xaa is A, C, G, P, M, V, I, L, Sce, or Sme
  MISC_FEATURE (69)..(69): Xaa is F, W, or Y
  MISC_FEATURE (70)..(71): Xaa is A, C, G, P, M, V, I, L, Sce, or Sme
  MISC_FEATURE (72)..(72): Xaa is S, T, N or Q
  MISC_FEATURE (73)..(73): Xaa is D or E
  MISC_FEATURE (74)..(74): Xaa is A, C, G, P, M, V, I, L, Sce, or Sme
  MISC_FEATURE (75)..(75): Xaa is D or E
  MISC_FEATURE (76)..(76): Xaa is R, H, or K
  MISC_FEATURE (77)..(77): Xaa is A, C, G, P, M, V, I, L, Sce, or Sme
  MISC_FEATURE (78)..(79): Xaa is S, T, N or Q
  MISC_FEATURE (81)..(81): Xaa is A, C, G, P, M, V, I, L, Sce, or Sme
  MISC_FEATURE (82)..(82): Xaa is S, T, N or Q
  MISC_FEATURE (85)..(85): Xaa is A, C, G, P, M, V, I, L, Sce, or Sme
  MISC_FEATURE (89)..(93): Xaa is A, C, G, P, M, V, I, L, Sce, or Sme
  MISC_FEATURE (94)..(94): Xaa is D or E
  MISC_FEATURE (95)..(95): Xaa is R, H, or K
  MISC_FEATURE (96)..(96): Xaa is A, C, G, P, M, V, I, L, Sce, or Sme
  MISC_FEATURE (97)..(97): Xaa is F, W, or Y
  MISC_FEATURE (98)..(99): Xaa is A, C, G, P, M, V, I, L, Sce, or Sme
  MISC_FEATURE (100)..(101): Xaa is F, W, or Y
  MISC_FEATURE (102)..(102): Xaa is S, T, N or Q
  MISC_FEATURE (103)..(104): Xaa is A, C, G, P, M, V, I, L, Sce, or Sme
  MISC_FEATURE (105)..(105): Xaa is R, H, or K
  MISC_FEATURE (106)..(107): Xaa is A, C, G, P, M, V, I, L, Sce, or Sme
  MISC_FEATURE (108)..(108): Xaa is F, W, or Y
  MISC_FEATURE (109)..(109): Xaa is S, T, N or Q
  MISC_FEATURE (110)..(110): Xaa is A, C, G, P, M, V, I, L, Sce, or Sme
  MISC_FEATURE (111)..(112): Xaa is S, T, N or Q
  MISC_FEATURE (113)..(113): Xaa is F, W, or Y

SEQ ID NO: 42 - protein, 159 aa, Artificial Sequence
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is D or E
  MISC_FEATURE (5)..(5): Xaa is A, C, G, P, M, V, I, L, Sme, or Sce
  MISC_FEATURE (8)..(8): Xaa is D or E
  MISC_FEATURE (9)..(9): Xaa is A, C, G, P, M, V, I, L, Sme, or Sce
  MISC_FEATURE (11)..(11): Xaa is D or E
  MISC_FEATURE (12)..(12): Xaa is A, C, G, P, M, V, I, L, Sme, or Sce
  MISC_FEATURE (13)..(13): Xaa is S, T, N, or Q
  MISC_FEATURE (17)..(17): Xaa is A, C, G, P, M, V, I, L, Sme, or Sce
  MISC_FEATURE (23)..(23): Xaa is S, T, N, or Q
  MISC_FEATURE (26)..(26): Xaa is D or E
  MISC_FEATURE (28)..(28): Xaa is D or E
  MISC_FEATURE (29)..(29): Xaa is A, C, G, P, M, V, I, L, Sme, or Sce
  MISC_FEATURE (30)..(30): Xaa is R, H, or K
  MISC_FEATURE (31)..(32): Xaa is A, C, G, P, M, V, I, L, Sme, or Sce
  MISC_FEATURE (35)..(35): Xaa is A, C, G, P, M, V, I, L, Sme, or Sce
  MISC_FEATURE (37)..(37): Xaa is S, T, N, or Q
  MISC_FEATURE (38)..(38): Xaa is A, C, G, P, M, V, I, L, Sme, or Sce
  MISC_FEATURE (43)..(43): Xaa is A, C, G, P, M, V, I, L, Sme, or Sce
  MISC_FEATURE (46)..(46): Xaa is D or E
  MISC_FEATURE (51)..(51): Xaa is R, H, or K
  MISC_FEATURE (52)..(52): Xaa is S, T, N, or Q
  MISC_FEATURE (54)..(54): Xaa is A, C, G, P, M, V, I, L, Sme, or Sce
  MISC_FEATURE (58)..(58): Xaa is A, C, G, P, M, V, I, L, Sme, or Sce
  MISC_FEATURE (59)..(59): Xaa is D or E
  MISC_FEATURE (60)..(60): Xaa is A, C, G, P, M, V, I, L, Sme, or Sce
  MISC_FEATURE (63)..(64): Xaa is A, C, G, P, M, V, I, L, Sme, or Sce
  MISC_FEATURE (65)..(65): Xaa is F, W, or Y
  MISC_FEATURE (66)..(66): Xaa is A, C, G, P, M, V, I, L, Sme, or Sce
  MISC_FEATURE (84)..(84): Xaa is S, T, N, or Q
  MISC_FEATURE (87)..(87): Xaa is A, C, G, P, M, V, I, L, Sme, or Sce
  MISC_FEATURE (91)..(92): Xaa is D or E
  MISC_FEATURE (94)..(94): Xaa is A, C, G, P, M, V, I, L, Sme, or Sce
  MISC_FEATURE (103)..(103): Xaa is D or E
  MISC_FEATURE (104)..(104): Xaa is R, H, or K
  MISC_FEATURE (106)..(107): Xaa is R, H, or K
  MISC_FEATURE (112)..(112): Xaa is A, C, G, P, M, V, I, L, Sme, or Sce
  MISC_FEATURE (126)..(126): Xaa is R, H, or K
  MISC_FEATURE (127)..(127): Xaa is S, T, N, or Q
  MISC_FEATURE (133)..(133): Xaa is A, C, G, P, M, V, I, L, Sme, or Sce
  MISC_FEATURE (135)..(136): Xaa is D or E
  MISC_FEATURE (141)..(141): Xaa is R, H, or K
  MISC_FEATURE (142)..(142): Xaa is F, W, or Y
  MISC_FEATURE (144)..(144): Xaa is D or E
  MISC_FEATURE (153)..(153): Xaa is R, H, or K
  MISC_FEATURE (155)..(155): Xaa is S, T, N, or Q
  MISC_FEATURE (157)..(157): Xaa is S, T, N, or Q
  MISC_FEATURE (158)..(158): Xaa is A, C, G, P, M, V, I, L, Sme, or Sce
  MISC_FEATURE (159)..(159): Xaa is R, H, or K
XXXVXIGXXKXXXGMEXAAVYLXPIXMXXXXXDLXAXXADIHXEAXIHALXXNXNGFXXXFWXXXXTIAYALANADTGAIKTGXLMXMVAXXGXHYGANIAMXXDXXGGFGXGTYALTFLISNPEXXGFGRHXDXXTGVGXXFXPFVVTYFFXYXGXXX

SEQ ID NO: 43 - protein, 184 aa, Artificial Sequence
  Synthetic
  MISC_FEATURE (1)..(1): Xaa is any amino acid or is optionally absent
  MISC_FEATURE (2)..(2): Xaa is S, T, N, or Q
  MISC_FEATURE (11)..(11): Xaa is S, T, N, or Q
  MISC_FEATURE (17)..(17): Xaa is A, C, G, P, M, V, I, L, Selenomethionine (Sme), or Selenocysteine (Sce)
  MISC_FEATURE (22)..(22): Xaa is A, C, G, P, M, V, I, L, Sce or Sme
  MISC_FEATURE (25)..(25): Xaa is R, H or K
  MISC_FEATURE (26)..(26): Xaa is S, T, N, or Q
  MISC_FEATURE (28)..(28): Xaa is S, T, N, or Q
  MISC_FEATURE (30)..(30): Xaa is D or E
  MISC_FEATURE (31)..(31): Xaa is A, C, G, P, M, V, I, L, Sce or Sme
  MISC_FEATURE (34)..(34): Xaa is S, T, N, or Q
  MISC_FEATURE (35)..(35): Xaa is R, H or K
  MISC_FEATURE (36)..(36): Xaa is S, T, N, or Q
  MISC_FEATURE (38)..(38): Xaa is S, T, N, or Q
  MISC_FEATURE (39)..(39): Xaa is A, C, G, P, M, V, I, L, Sce or Sme
  MISC_FEATURE (49)..(49): Xaa is D or E
  MISC_FEATURE (50)..(51): Xaa is A, C, G, P, M, V, I, L, Sce or Sme
  MISC_FEATURE (54)..(55): Xaa is S, T, N, or Q
  MISC_FEATURE (58)..(58): Xaa is D or E
  MISC_FEATURE (61)..(63): Xaa is S, T, N, or Q
  MISC_FEATURE (65)..(65): Xaa is A, C, G, P, M, V, I, L, Sce or Sme
  MISC_FEATURE (66)..(66): Xaa is D or E
  MISC_FEATURE (68)..(69): Xaa is A, C, G, P, M, V, I, L, Sce or Sme
  MISC_FEATURE (70)..(70): Xaa is D or E
  MISC_FEATURE (71)..(71): Xaa is S, T, N, or Q
  MISC_FEATURE (72)..(73): Xaa is A, C, G, P, M, V, I, L, Sce or Sme
  MISC_FEATURE (75)..(75): Xaa is A, C, G, P, M, V, I, L, Sce or Sme
  MISC_FEATURE (76)..(76): Xaa is S, T, N, or Q
  MISC_FEATURE (79)..(79): Xaa is A, C, G, P, M, V, I, L, Sce or Sme
  MISC_FEATURE (82)..(83): Xaa is A, C, G, P, M, V, I, L, Sce or Sme
  MISC_FEATURE (85)..(85): Xaa is A, C, G, P, M, V, I, L, Sce or Sme
  MISC_FEATURE (86)..(86): Xaa is S, T, N, or Q
  MISC_FEATURE (88)..(88): Xaa is A, C, G, P, M, V, I, L, Sce or Sme
  MISC_FEATURE (89)..(90): Xaa is S, T, N, or Q
  MISC_FEATURE (91)..(91): Xaa is A, C, G, P, M, V, I, L, Sce or Sme
  MISC_FEATURE (92)..(92): Xaa is D or E
  MISC_FEATURE (93)..(94): Xaa is R, H or K
  MISC_FEATURE (95)..(95): Xaa is S, T, N, or Q
  MISC_FEATURE (106)..(106): Xaa is A, C, G, P, M, V, I, L, Sce or Sme
  MISC_FEATURE (109)..(109): Xaa is A, C, G, P, M, V, I, L, Sce or Sme
  MISC_FEATURE (110)..(110): Xaa is S, T, N, or Q
  MISC_FEATURE (122)..(122): Xaa is S, T, N, or Q
  MISC_FEATURE (127)..(127): Xaa is R, H or K
  MISC_FEATURE (128)..(129): Xaa is A, C, G, P, M, V, I, L, Sce or Sme
  MISC_FEATURE (130)..(130): Xaa is F, W, or Y
  MISC_FEATURE (132)..(133): Xaa is A, C, G, P, M, V, I, L, Sce or Sme
  MISC_FEATURE (161)..(161): Xaa is R, H or K
  MISC_FEATURE (162)..(162): Xaa is A, C, G, P, M, V, I, L, Sce or Sme
  MISC_FEATURE (164)..(165): Xaa is A, C, G, P, M, V, I, L, Sce or Sme
  MISC_FEATURE (175)..(175): Xaa is D or E
  MISC_FEATURE (176)..(176): Xaa is A, C, G, P, M, V, I, L, Sce or Sme
  MISC_FEATURE (179)..(179): Xaa is R, H or K
  MISC_FEATURE (180)..(180): Xaa is S, T, N, or Q
  MISC_FEATURE (181)..(182): Xaa is A, C, G, P, M, V, I, L, Sce or Sme
  MISC_FEATURE (183)..(183): Xaa is D or E
  MISC_FEATURE (184)..(184): Xaa is A, C, G, P, M, V, I, L, Sce or Sme
XXQAIGILELXSIAKGXELGDXMLXXAXVXXLVXXXIXXGKFLLMLGGXXXAIXXAIXTGXXXAXXMXXXXXXLXXIHXSVXXAXXGXXXXXXXXAVGIVETWSVXACXXAADLAVKGSNVXLVRVXXXXGXXGKCYMVVAGDVLDVAAAVATASLAAGAXXLXXYASIIPRPHXXMWXXXXXX

SEQ ID NO: 44 - protein, 103 aa, Artificial Sequence
  Synthetic
  MISC_FEATURE (1)..(1): Xaa is any amino acid or is optionally absent
  MISC_FEATURE (24)..(25): Xaa is D or E
  MISC_FEATURE (26)..(26): Xaa is R, H, or K
  MISC_FEATURE (41)..(41): Xaa is F, W, or Y
  MISC_FEATURE (44)..(44): Xaa is S, T, N, or Q
  MISC_FEATURE (45)..(45): Xaa is A, C, G, P, M, V, I, L, Selenomethionine (Sme), or Selenocysteine (Sce)
  MISC_FEATURE (61)..(61): Xaa is S, T, N, or Q
  MISC_FEATURE (62)..(62): Xaa is R, H, or K
  MISC_FEATURE (65)..(65): Xaa is A, C, G, P, M, V, I, L, Sce, or Sme
  MISC_FEATURE (66)..(66): Xaa is R, H, or K
  MISC_FEATURE (69)..(69): Xaa is D or E
  MISC_FEATURE (70)..(70): Xaa is R, H, or K
  MISC_FEATURE (72)..(72): Xaa is R, H, or K
  MISC_FEATURE (73)..(73): Xaa is A, C, G, P, M, V, I, L, Sce, or Sme
  MISC_FEATURE (76)..(76): Xaa is A, C, G, P, M, V, I, L, Sce, or Sme
  MISC_FEATURE (77)..(77): Xaa is F, W, or Y
  MISC_FEATURE (78)..(78): Xaa is S, T, N, or Q
  MISC_FEATURE (79)..(79): Xaa is A, C, G, P, M, V, I, L, Sce, or Sme
  MISC_FEATURE (88)..(88): Xaa is A, C, G, P, M, V, I, L, Sce, or Sme
  MISC_FEATURE (89)..(89): Xaa is D or E
  MISC_FEATURE (92)..(92): Xaa is R, H, or K
  MISC_FEATURE (93)..(93): Xaa is D or E
  MISC_FEATURE (96)..(96): Xaa is D or E
  MISC_FEATURE (99)..(99): Xaa is R, H, or K
  MISC_FEATURE (100)..(100): Xaa is D or E
XEEVVLITVPSALVAVKIAHALVXXXLAACVNIVPGLTSIXRWXXSVVSDHELLLLVKTTXXAFXXLKXXVXXLHXXXXPEIVALPIXXGNXXYLXWLXXNTG

SEQ ID NO: 45 - protein, 122 aa, Artificial Sequence
  Synthetic
  MISC_FEATURE (1)..(1): Xaa is any amino acid or is optionally absent
  MISC_FEATURE (14)..(14): Xaa is D or E
  MISC_FEATURE (35)..(35): Xaa is A, C, G, P, M, V, I, L, Selenomethionine (Sme), or Selenocysteine (Sce)
  MISC_FEATURE (37)..(37): Xaa is S, T, N, or Q
  MISC_FEATURE (39)..(39): Xaa is F, W, or Y
  MISC_FEATURE (40)..(40): Xaa is D or E
  MISC_FEATURE (51)..(52): Xaa is D or E
  MISC_FEATURE (69)..(69): Xaa is R, H, or K
  MISC_FEATURE (79)..(79): Xaa is A, C, G, P, M, V, I, L, Sce, Sme
  MISC_FEATURE (81)..(82): Xaa is A, C, G, P, M, V, I, L, Sce, Sme
  MISC_FEATURE (85)..(85): Xaa is A, C, G, P, M, V, I, L, Sce, Sme
  MISC_FEATURE (86)..(86): Xaa is R, H, or K
  MISC_FEATURE (97)..(97): Xaa is D or E
  MISC_FEATURE (99)..(99): Xaa is A, C, G, P, M, V, I, L, Sce, Sme
  MISC_FEATURE (101)..(101): Xaa is D or E
  MISC_FEATURE (102)..(102): Xaa is R, H, or K
  MISC_FEATURE (104)..(104): Xaa is R, H, or K
  MISC_FEATURE (110)..(110): Xaa is D or E
  MISC_FEATURE (112)..(112): Xaa is A, C, G, P, M, V, I, L, Sce, Sme
  MISC_FEATURE (113)..(113): Xaa is R, H, or K
  MISC_FEATURE (116)..(116): Xaa is A, C, G, P, M, V, I, L, Sce, Sme
  MISC_FEATURE (117)..(117): Xaa is D or E
  MISC_FEATURE (118)..(118): Xaa is A, C, G, P, M, V, I, L, Sce, Sme
  MISC_FEATURE (119)..(119): Xaa is D or E
  MISC_FEATURE (120)..(120): Xaa is S, T, N, or Q
  MISC_FEATURE (121)..(121): Xaa is A, C, G, P, M, V, I, L, Sce, Sme
  MISC_FEATURE (122)..(122): Xaa is S, T, N, or Q
XVRGIRGAITVEEXTPAAILAATIELLLKMLEANXIXSXXELAAVIFTVTXXLTSAFPAEAARLIGMHXVPLLSAREVXVXXSLXXVIRVLALWNTXTXQXXVXHVYLNXAXXLRXXXXXXX

SEQ ID NO: 46 - protein, 177 aa, Artificial Sequence
  Synthetic
  MISC_FEATURE (1)..(1): Xaa is any amino acid or optionally absent
  MISC_FEATURE (2)..(2): Xaa is S, T, N or Q
  MISC_FEATURE (3)..(3): Xaa is R, H or K
  MISC_FEATURE (16)..(16): Xaa is S, T, N or Q
  MISC_FEATURE (17)..(19): Xaa is A, C, G, P, M, V, I, L, Selenomethionine (Sme), or Selenocysteine (Sce)
  MISC_FEATURE (20)..(20): Xaa is S, T, N or Q
  MISC_FEATURE (21)..(21): Xaa is A, C, G, P, M, V, I, L, Sce, or Sme
  MISC_FEATURE (37)..(37): Xaa is S, T, N or Q
  MISC_FEATURE (39)..(39): Xaa is D or E
  MISC_FEATURE (42)..(42): Xaa is A, C, G, P, M, V, I, L, Sce, or Sme
  MISC_FEATURE (44)..(44): Xaa is F, W, or Y
  MISC_FEATURE (45)..(45): Xaa is S, T, N or Q
  MISC_FEATURE (51)..(51): Xaa is S, T, N or Q
  MISC_FEATURE (52)..(52): Xaa is D or E
  MISC_FEATURE (53)..(53): Xaa is A, C, G, P, M, V, I, L, Sce, or Sme
  MISC_FEATURE (56)..(56): Xaa is S, T, N or Q
  MISC_FEATURE (59)..(59): Xaa is A, C, G, P, M, V, I, L, Sce, or Sme
  MISC_FEATURE (63)..(64): Xaa is D or E
  MISC_FEATURE (65)..(65): Xaa is S, T, N or Q
  MISC_FEATURE (66)..(66): Xaa is D or E
  MISC_FEATURE (80)..(81): Xaa is R, H or K
  MISC_FEATURE (89)..(89): Xaa is D or E
  MISC_FEATURE (90)..(90): Xaa is A, C, G, P, M, V, I, L, Sce, or Sme
  MISC_FEATURE (93)..(93): Xaa is D or E
  MISC_FEATURE (95)..(95): Xaa is A, C, G, P, M, V, I, L, Sce, or Sme
  MISC_FEATURE (105)..(105): Xaa is A, C, G, P, M, V, I, L, Sce, or Sme
  MISC_FEATURE (106)..(106): Xaa is D or E
  MISC_FEATURE (108)..(108): Xaa is A, C, G, P, M, V, I, L, Sce, or Sme
  MISC_FEATURE (109)..(109): Xaa is R, H or K
  MISC_FEATURE (110)..(110): Xaa is D or E
  MISC_FEATURE (124)..(124): Xaa is R, H or K
  MISC_FEATURE (126)..(126): Xaa is D or E
  MISC_FEATURE (135)..(135): Xaa is D or E
  MISC_FEATURE (152)..(152): Xaa is F, W, or Y
  MISC_FEATURE (156)..(156): Xaa is A, C, G, P, M, V, I, L, Sce, or Sme
  MISC_FEATURE (158)..(158): Xaa is D or E
  MISC_FEATURE (161)..(161): Xaa is F, W, or Y
  MISC_FEATURE (165)..(165): Xaa is S, T, N or Q
  MISC_FEATURE (166)..(166): Xaa is D or E
  MISC_FEATURE (170)..(170): Xaa is R, H or K
  MISC_FEATURE (173)..(173): Xaa is R, H or K
  MISC_FEATURE (174)..(174): Xaa is A, C, G, P, M, V, I, L, Sce, or Sme
  MISC_FEATURE (175)..(175): Xaa is R, H or K
  MISC_FEATURE (176)..(176): Xaa is A, C, G, P, M, V, I, L, Sce, or Sme
  MISC_FEATURE (177)..(177): Xaa is R, H or K
XXXAKIGIVTVSDRAXXXXXXDISGKAIILALNLYLXSXWEXIXXVIPDEXXXIEXTLXKMAXXXXCCLIVTTGGTGPAXXDVTPEATXXVCXRXMPGFGELMRXXSXXXVPTAILSRQTAGLXGXSLIVNLPGXPASISDCLLAVFPAIPXCIDXMXGPXLECXXAMIXPFXXXXX

SEQ ID NO: 47 - protein, 122 aa, Artificial Sequence
  Synthetic
  MISC_FEATURE (1)..(1): Xaa is any amino acid or is optionally absent
  MISC_FEATURE (14)..(14): Xaa is D or E
  MISC_FEATURE (32)..(32): Xaa is D or E
  MISC_FEATURE (33)..(33): Xaa is A, C, G, P, M, V, I, L, Selenomethionine (Sme), or Selenocysteine (Sce)
  MISC_FEATURE (35)..(35): Xaa is A, C, G, P, M, V, I, L, Sce, or Sme
  MISC_FEATURE (37)..(37): Xaa is S, T, N, or Q
  MISC_FEATURE (39)..(39): Xaa is F, W, or Y
  MISC_FEATURE (41)..(41): Xaa is D or E
  MISC_FEATURE (51)..(52): Xaa is D or E
  MISC_FEATURE (57)..(57): Xaa is F, W, or Y
  MISC_FEATURE (68)..(68): Xaa is R, H, or K
  MISC_FEATURE (79)..(79): Xaa is A, C, G, P, M, V, I, L, Sce, or Sme
  MISC_FEATURE (81)..(82): Xaa is A, C, G, P, M, V, I, L, Sce, or Sme
  MISC_FEATURE (85)..(85): Xaa is A, C, G, P, M, V, I, L, Sce, or Sme
  MISC_FEATURE (86)..(86): Xaa is R, H, or K
  MISC_FEATURE (97)..(97): Xaa is D or E
  MISC_FEATURE (99)..(99): Xaa is A, C, G, P, M, V, I, L, Sce, or Sme
  MISC_FEATURE (101)..(101): Xaa is D or E
  MISC_FEATURE (102)..(102): Xaa is R, H, or K
  MISC_FEATURE (104)..(105): Xaa is R, H, or K
  MISC_FEATURE (107)..(107): Xaa is F, W, or Y
  MISC_FEATURE (112)..(112): Xaa is A, C, G, P, M, V, I, L, Sce, or Sme
  MISC_FEATURE (113)..(113): Xaa is R, H, or K
  MISC_FEATURE (114)..(114): Xaa is A, C, G, P, M, V, I, L, Sce, or Sme
  MISC_FEATURE (115)..(115): Xaa is R, H, or K
  MISC_FEATURE (116)..(116): Xaa is A, C, G, P, M, V, I, L, Sce, or Sme
  MISC_FEATURE (117)..(117): Xaa is D or E
  MISC_FEATURE (118)..(118): Xaa is A, C, G, P, M, V, I, L, Sce, or Sme
  MISC_FEATURE (119)..(119): Xaa is D or E
  MISC_FEATURE (120)..(120): Xaa is S, T, N, or Q
  MISC_FEATURE (121)..(121): Xaa is A, C, G, P, M, V, I, L, Sce, or Sme
  MISC_FEATURE (122)..(122): Xaa is S, T, N, or Q
XVRGIRGAITVNSXTPTSIIIATILLLEKMLXXNXIXSXEXLAAVIFTVTXXLTSAXPAEAARQIGMXRVPLLSAREVXVXXSLXXVIRVLALWNTXTXQXXVXXVXLSEAXXXXXXXXXXX

SEQ ID NO: 48 - protein, 172 aa, Artificial Sequence
  Synthetic
  MISC_FEATURE (1)..(1): Xaa is any amino acid or is optionally absent
  MISC_FEATURE (2)..(2): Xaa is R, H or K
  MISC_FEATURE (3)..(3): Xaa is A, C, G, P, M, V, I, L, Selenomethionine (Sme), or Selenocysteine (Sce)
  MISC_FEATURE (4)..(5): Xaa is S, T, N or Q
  MISC_FEATURE (6)..(6): Xaa is R, H or K
  MISC_FEATURE (7)..(8): Xaa is A, C, G, P, M, V, I, L, Sce, or Sme
  MISC_FEATURE (9)..(9): Xaa is D or E
  MISC_FEATURE (10)..(10): Xaa is R, H or K
  MISC_FEATURE (11)..(11): Xaa is A, C, G, P, M, V, I, L, Sce, or Sme
  MISC_FEATURE (12)..(13): Xaa is S, T, N or Q
  MISC_FEATURE (14)..(14): Xaa is R, H or K
  MISC_FEATURE (15)..(15): Xaa is A, C, G, P, M, V, I, L, Sce, or Sme
  MISC_FEATURE (16)..(16): Xaa is F, W or Y
  MISC_FEATURE (17)..(18): Xaa is A, C, G, P, M, V, I, L, Sce, or Sme
  MISC_FEATURE (19)..(20): Xaa is D or E
  MISC_FEATURE (21)..(21): Xaa is A, C, G, P, M, V, I, L, Sce, or Sme
  MISC_FEATURE (22)..(22): Xaa is F, W or Y
  MISC_FEATURE (24)..(24): Xaa is D or E
  MISC_FEATURE (25)..(25): Xaa is S, T, N or Q
  MISC_FEATURE (28)..(28): Xaa is A, C, G, P, M, V, I, L, Sce, or Sme
  MISC_FEATURE (29)..(29): Xaa is D or E
  MISC_FEATURE (46)..(46): Xaa is R, H or K
  MISC_FEATURE (49)..(51): Xaa is D or E
  MISC_FEATURE (53)..(53): Xaa is R, H or K
  MISC_FEATURE (58)..(58): Xaa is D or E
  MISC_FEATURE (64)..(64): Xaa is F, W or Y
  MISC_FEATURE (73)..(73): Xaa is R, H or K
  MISC_FEATURE (75)..(75): Xaa is R, H or K
  MISC_FEATURE (76)..(76): Xaa is A, C, G, P, M, V, I, L, Sce, or Sme
  MISC_FEATURE (77)..(77): Xaa is D or E
  MISC_FEATURE (80)..(80): Xaa is S, T, N or Q
  MISC_FEATURE (82)..(82): Xaa is D or E
  MISC_FEATURE (83)..(83): Xaa is R, H or K
  MISC_FEATURE (89)..(89): Xaa is R, H or K
  MISC_FEATURE (93)..(93): Xaa is R, H or K
  MISC_FEATURE (96)..(96): Xaa is D or E
  MISC_FEATURE (97)..(97): Xaa is A, C, G, P, M, V, I, L, Sce, or Sme
  MISC_FEATURE (99)..(99): Xaa is S, T, N or Q
  MISC_FEATURE (100)..(100): Xaa is A, C, G, P, M, V, I, L, Sce, or Sme
  MISC_FEATURE (101)..(101): Xaa is R, H or K
  MISC_FEATURE (102)..(102): Xaa is S, T, N or Q
  MISC_FEATURE (103)..(103): Xaa is F, W or Y
  MISC_FEATURE (104)..(104): Xaa is A, C, G, P, M, V, I, L, Sce, or Sme
  MISC_FEATURE (111)..(111): Xaa is D or E
  MISC_FEATURE (123)..(123): Xaa is R, H or K
  MISC_FEATURE (131)..(131): Xaa is S, T, N or Q
  MISC_FEATURE (135)..(135): Xaa is D or E
  MISC_FEATURE (136)..(136): Xaa is F, W or Y
  MISC_FEATURE (154)..(154): Xaa is F, W or Y
  MISC_FEATURE (162)..(162): Xaa is A, C, G, P, M, V, I, L, Sce, or Sme
  MISC_FEATURE (163)..(163): Xaa is D or E
  MISC_FEATURE (164)..(164): Xaa is R, H or K
  MISC_FEATURE (165)..(165): Xaa is S, T, N or Q
  MISC_FEATURE (166)..(166): Xaa is R, H or K
  MISC_FEATURE (167)..(167): Xaa is A, C, G, P, M, V, I, L, Sce, or Sme
  MISC_FEATURE (168)..(168): Xaa is R, H or K
  MISC_FEATURE (169)..(169): Xaa is D or E
  MISC_FEATURE (170)..(170): Xaa is A, C, G, P, M, V, I, L, Sce, or Sme
  MISC_FEATURE (171)..(171): Xaa is R, H or K
  MISC_FEATURE (172)..(172): Xaa is S, T, N or Q
XXXXXXXXXXXXXXXXXXXXXXKXXPIXXANGTLDELTSFIGEAKXYVXXXMXGILEXIQNDIXKIMGEIGSXGXXXGIXEXXIAWLLXLILXYMXXVXXXXXXLPGGTLXSAKLDVCRTIAXRALRKVLXVTRXXGIGAEAAAYLLALSDLLXLLARVIEXXXXXXXXXXX

SEQ ID NO: 49 - protein, 123 aa, Artificial Sequence
  Synthetic
  MISC_FEATURE (1)..(1): Xaa is any amino acid or is optionally absent
  MISC_FEATURE (13)..(13): Xaa is R, H, or K
  MISC_FEATURE (15)..(15): Xaa is D or E
  MISC_FEATURE (17)..(108): Xaa is S, T, N or Q
  MISC_FEATURE (20)..(20): Xaa is D or E
  MISC_FEATURE (24)..(24): Xaa is S, T, N or Q
  MISC_FEATURE (33)..(33): Xaa is A, C, G, P, M, V, I, L, Selenomethionine (Sme), or Selenocysteine (Sce)
  MISC_FEATURE (39)..(39): Xaa is D or E
  MISC_FEATURE (42)..(42): Xaa is S, T, N or Q
  MISC_FEATURE (43)..(43): Xaa is R, H, or K
  MISC_FEATURE (46)..(46): Xaa is S, T, N or Q
  MISC_FEATURE (48)..(48): Xaa is D or E
  MISC_FEATURE (51)..(51): Xaa is R, H, or K
  MISC_FEATURE (54)..(54): Xaa is S, T, N or Q
  MISC_FEATURE (56)..(57): Xaa is A, C, G, P, M, V, I, L, Sce, or Sme
  MISC_FEATURE (58)..(58): Xaa is D or E
  MISC_FEATURE (70)..(70): Xaa is D or E
  MISC_FEATURE (72)..(72): Xaa is R, H, or K
  MISC_FEATURE (90)..(90): Xaa is D or E
  MISC_FEATURE (97)..(98): Xaa is D or E
  MISC_FEATURE (108)..(108): Xaa is D or E
  MISC_FEATURE (111)..(111): Xaa is R, H, or K
  MISC_FEATURE (118)..(120): Xaa is A, C, G, P, M, V, I, L, Sce, or Sme
  MISC_FEATURE (121)..(121): Xaa is R, H, or K
  MISC_FEATURE (122)..(122): Xaa is S, T, N or Q
  MISC_FEATURE (123)..(123): Xaa is R, H, or K
XPHLVIEATANLXLXTXPGXLLEXANKSLFASXQFGEAXIKXXFVXLXAYXQGXAXXXRAYLHACLSILXGXDIATRTLLGASLCAVLAXAVAGGGXXGVQVSVEVRXMEXLSYAKRXXXXXX

SEQ ID NO: 50 - protein, 158 aa, Artificial Sequence
  Synthetic
  MISC_FEATURE (1)..(1): Xaa is any amino acid or is optionally absent
  MISC_FEATURE (2)..(2): Xaa is D or E
  MISC_FEATURE (3)..(3): Xaa is S, T, N or Q
  MISC_FEATURE (4)..(4): Xaa is A, C, G, P, M, V, I, L, Selenomethionine (Sme), or Selenocysteine (Sce)
  MISC_FEATURE (19)..(19): Xaa is F, W, or Y
  MISC_FEATURE (20)..(20): Xaa is D or E
  MISC_FEATURE (21)..(21): Xaa is S, T, N or Q
  MISC_FEATURE (30)..(30): Xaa is A, C, G, P, M, V, I, L, Sce, Sme
  MISC_FEATURE (31)..(31): Xaa is R, H, or K
  MISC_FEATURE (38)..(38): Xaa is R, H, or K
  MISC_FEATURE (45)..(45): Xaa is A, C, G, P, M, V, I, L, Sce, Sme
  MISC_FEATURE (46)..(46): Xaa is D or E
  MISC_FEATURE (62)..(62): Xaa is S, T, N or Q
  MISC_FEATURE (63)..(64): Xaa is D or E
  MISC_FEATURE (65)..(65): Xaa is A, C, G, P, M, V, I, L, Sce, Sme
  MISC_FEATURE (67)..(67): Xaa is R, H, or K
  MISC_FEATURE (79)..(79): Xaa is D or E
  MISC_FEATURE (82)..(82): Xaa is R, H, or K
  MISC_FEATURE (83)..(83): Xaa is S, T, N or Q
  MISC_FEATURE (84)..(84): Xaa is F, W, or Y
  MISC_FEATURE (87)..(87): Xaa is A, C, G, P, M, V, I, L, Sce, Sme
  MISC_FEATURE (89)..(89): Xaa is F, W, or Y
  MISC_FEATURE (94)..(95): Xaa is A, C, G, P, M, V, I, L, Sce, Sme
  MISC_FEATURE (96)..(96): Xaa is S, T, N or Q
  MISC_FEATURE (97)..(98): Xaa is A, C, G, P, M, V, I, L, Sce, Sme
  MISC_FEATURE (99)..(99): Xaa is S, T, N or Q
  MISC_FEATURE (100)..(100): Xaa is D or E
  MISC_FEATURE (101)..(101): Xaa is A, C, G, P, M, V, I, L, Sce, Sme
  MISC_FEATURE (102)..(102): Xaa is D or E
  MISC_FEATURE (103)..(103): Xaa is R, H, or K
  MISC_FEATURE (104)..(104): Xaa is D or E
  MISC_FEATURE (105)..(105): Xaa is S, T, N or Q
  MISC_FEATURE (109)..(109): Xaa is D or E
  MISC_FEATURE (115)..(115): Xaa is R, H, or K
  MISC_FEATURE (121)..(121): Xaa is D or E
  MISC_FEATURE (123)..(123): Xaa is A, C, G, P, M, V, I, L, Sce, Sme
  MISC_FEATURE (125)..(125): Xaa is D or E
  MISC_FEATURE (126)..(126): Xaa is R, H, or K
  MISC_FEATURE (127)..(127): Xaa is S, T, N or Q
  MISC_FEATURE (133)..(133): Xaa is D or E
  MISC_FEATURE (134)..(134): Xaa is A, C, G, P, M, V, I, L, Sce, Sme
  MISC_FEATURE (136)..(136): Xaa is A, C, G, P, M, V, I, L, Sce, Sme
  MISC_FEATURE (137)..(137): Xaa is R, H, or K
  MISC_FEATURE (138)..(139): Xaa is D or E
  MISC_FEATURE (140)..(141): Xaa is A, C, G, P, M, V, I, L, Sce, Sme
  MISC_FEATURE (142)..(142): Xaa is S, T, N or Q
  MISC_FEATURE (145)..(145): Xaa is S, T, N or Q
  MISC_FEATURE (147)..(147): Xaa is R, H, or K
  MISC_FEATURE (151)..(152): Xaa is D or E
  MISC_FEATURE (155)..(155): Xaa is R, H, or K
  MISC_FEATURE (156)..(156): Xaa is D or E
  MISC_FEATURE (157)..(157): Xaa is F, W, or Y
  MISC_FEATURE (158)..(158): Xaa is A, C, G, P, M, V, I, L, Sce, Sme
XXXXNTSFLSPSLVTIRDXXXGQFAVLRIXXTGFPADXGDIDLCXXKMIGVRAAQIFLGDDXXXXFXGPHIRIRCVDIXDKXXXNAXVXVDLIXXXXXXXXXXXXAEEXAKLALXVALQVXIXDXXXCVTQFXXKXXXXXXXSDXFXPDKXXYYXXXX

SEQ ID NO: 51 - protein, 113 aa, Artificial Sequence
  Synthetic
  MISC_FEATURE (1)..(1): Xaa is any amino acid or is optionally absent
  MISC_FEATURE (11)..(11): Xaa is A, C, G, P, M, V, I, L, Selenomethionine (Sme), or Selenocysteine (Sce)
  MISC_FEATURE (13)..(13): Xaa is D or E
  MISC_FEATURE (14)..(14): Xaa is R, H, or K
  MISC_FEATURE (16)..(17): Xaa is R, H, or K
  MISC_FEATURE (33)..(33): Xaa is A, C, G, P, M, V, I, L, Sce, or Sme
  MISC_FEATURE (35)..(35): Xaa is A, C, G, P, M, V, I, L, Sce, or Sme
  MISC_FEATURE (45)..(45): Xaa is D or E
  MISC_FEATURE (46)..(46): Xaa is S, T, N or Q
  MISC_FEATURE (55)..(55): Xaa is S, T, N or Q
  MISC_FEATURE (56)..(56): Xaa is D or E
  MISC_FEATURE (57)..(57): Xaa is A, C, G, P, M, V, I, L, Sce, or Sme
  MISC_FEATURE (66)..(67): Xaa is A, C, G, P, M, V, I, L, Sce, or Sme
  MISC_FEATURE (69)..(69): Xaa is F, W, or Y
  MISC_FEATURE (71)..(71): Xaa is A, C, G, P, M, V, I, L, Sce, or Sme
  MISC_FEATURE (72)..(72): Xaa is S, T, N or Q
  MISC_FEATURE (75)..(75): Xaa is D or E
  MISC_FEATURE (90)..(90): Xaa is A, C, G, P, M, V, I, L, Sce, or Sme
  MISC_FEATURE (92)..(92): Xaa is A, C, G, P, M, V, I, L, Sce, or Sme
  MISC_FEATURE (94)..(94): Xaa is D or E
  MISC_FEATURE (102)..(102): Xaa is S, T, N or Q
  MISC_FEATURE (104)..(104): Xaa is A, C, G, P, M, V, I, L, Sce, or Sme
  MISC_FEATURE (108)..(108): Xaa is F, W, or Y
  MISC_FEATURE (111)..(112): Xaa is S, T, N or Q
  MISC_FEATURE (113)..(113): Xaa is F, W, or Y
XPVIQTFVSTXLXXHXXLLLAIIYRIVTRVVLXKXEDLVMMTFHXXTPMHFFGSXXXVACVRVEAXXGXGXXEPXKVTSIVTAAITAVCXIXAXRIFVLYFXPXHCGXNGXXX

SEQ ID NO: 52 - protein, 16 aa, Artificial Sequence
  Synthetic
  MISC_FEATURE (1)..(1): optionally absent
MGCVQCKDKEATKLTE

SEQ ID NO: 53 - protein, 16 aa, Artificial Sequence
  Synthetic
  MISC_FEATURE (1)..(1): optionally absent
MGCIKSKRKDNLNDDE

SEQ ID NO: 54 - protein, 16 aa, Artificial Sequence
  Synthetic
  MISC_FEATURE (1)..(1): optionally absent
MGCVCSSNPEDDWMEN

SEQ ID NO: 55 - protein, 16 aa, Artificial Sequence
  Synthetic
  MISC_FEATURE (1)..(1): optionally absent
MGCMKSKFLQVGGNTG

SEQ ID NO: 56 - protein, 16 aa, Artificial Sequence
  Synthetic
  MISC_FEATURE (1)..(1): optionally absent
MGCVFCKKLEPVATAK

SEQ ID NO: 57 - protein, 16 aa, Artificial Sequence
  Synthetic
  MISC_FEATURE (1)..(1): optionally absent
MGCVHCKEKISGKGQG

SEQ ID NO: 58 - protein, 16 aa, Artificial Sequence
  Synthetic
  MISC_FEATURE (1)..(1): optionally absent
MGLLSSKRQVSEKGKG

SEQ ID NO: 59 - protein, 16 aa, Artificial Sequence
  Synthetic
  MISC_FEATURE (1)..(1): optionally absent
MGQQPGKVLGDQRRPS

SEQ ID NO: 60 - protein, 16 aa, Artificial Sequence
  Synthetic
  MISC_FEATURE (1)..(1): optionally absent
MGQQVGRVGEAPGLQQ

SEQ ID NO: 61 - protein, 16 aa, Artificial Sequence
  Synthetic
  MISC_FEATURE (1)..(1): optionally absent
MGNAAAAKKGSEQESV

SEQ ID NO: 62 - protein, 16 aa, Artificial Sequence
  Synthetic
  MISC_FEATURE (1)..(1): optionally absent
MGNAATAKKGSEVESV

SEQ ID NO: 63 - protein, 16 aa, Artificial Sequence
  Synthetic
  MISC_FEATURE (1)..(1): optionally absent
MGAQLSLVVQASPSIA

SEQ ID NO: 64 - protein, 16 aa, Artificial Sequence
  Synthetic
  MISC_FEATURE (1)..(1): optionally absent
MGHALCVCSRGTVIID

SEQ ID NO: 65 - protein, 16 aa, Artificial Sequence
  Synthetic
  MISC_FEATURE (1)..(1): optionally absent
MGQLCCFPFSRDEGKI

SEQ ID NO: 66 - protein, 16 aa, Artificial Sequence
  Synthetic
  MISC_FEATURE (1)..(1): optionally absent
MGNEASYPLEMCSHFD

SEQ ID NO: 67 - protein, 16 aa, Artificial Sequence
  Synthetic
  MISC_FEATURE (1)..(1): optionally absent
MGNSGSKQHTKHNSKK

SEQ ID NO: 68 - protein, 16 aa, Artificial Sequence
  Synthetic
  MISC_FEATURE (1)..(1): optionally absent
MGCTLSAEDKAAVERS

SEQ ID NO: 69 - protein, 16 aa, Artificial Sequence
  Synthetic
  MISC_FEATURE (1)..(1): optionally absent
MGCTLSAEERAALERS

SEQ ID NO: 70 - protein, 16 aa, Artificial Sequence
  Synthetic
  MISC_FEATURE (1)..(1): optionally absent
MGAGASAEEKHSRELE

SEQ ID NO: 71 - protein, 16 aa, Artificial Sequence
  Synthetic
  MISC_FEATURE (1)..(1): optionally absent
MGCRQSSEEKEAARRS

SEQ ID NO: 72 - protein, 16 aa, Artificial Sequence
  Synthetic
  MISC_FEATURE (1)..(1): optionally absent
MGLSFTKLFSRLFAKK

SEQ ID NO: 73 - protein, 16 aa, Artificial Sequence
  Synthetic
  MISC_FEATURE (1)..(1): optionally absent
MGNIFGNLLKSLIGKK

SEQ ID NO: 74 - protein, 16 aa, Artificial Sequence
  Synthetic
  MISC_FEATURE (1)..(1): optionally absent
MGLTVSALFSRIFGKK

SEQ ID NO: 75 - protein, 16 aa, Artificial Sequence
  Synthetic
  MISC_FEATURE (1)..(1): optionally absent
MGKVLSKIFGNKEMRI

SEQ ID NO: 76 - protein, 16 aa, Artificial Sequence
  Synthetic
  MISC_FEATURE (1)..(1): optionally absent
MGNSKSGALSKEILEE

SEQ ID NO: 77 - protein, 16 aa, Artificial Sequence
  Synthetic
  MISC_FEATURE (1)..(1): optionally absent
MGKQNSKLRPEVMQDL

SEQ ID NO: 78 - protein, 16 aa, Artificial Sequence
  Synthetic
  MISC_FEATURE (1)..(1): optionally absent
MGKRASKLKPEEVEEL

SEQ ID NO: 79 - protein, 16 aa, Artificial Sequence
  Synthetic
  MISC_FEATURE (1)..(1): optionally absent
MGKQNSKLRPEVLQDL

SEQ ID NO: 80 - protein, 16 aa, Artificial Sequence
  Synthetic
  MISC_FEATURE (1)..(1): optionally absent
MGSRASTLLRDEELEE

SEQ ID NO: 81 - protein, 16 aa, Artificial Sequence
  Synthetic
  MISC_FEATURE (1)..(1): optionally absent
MGSKLSKKKKGYNVND

SEQ ID NO: 82 - protein, 16 aa, Artificial Sequence
  Synthetic
  MISC_FEATURE (1)..(1): optionally absent
MGKQNSKLRPEMLQDL

SEQ ID NO: 83 - protein, 16 aa, Artificial Sequence
  Synthetic
  MISC_FEATURE (1)..(1): optionally absent
MGNVMEGKSVEELSST

SEQ ID NO: 84 - protein, 16 aa, Artificial Sequence
  Synthetic
  MISC_FEATURE (1)..(1): optionally absent
MGQQFSWEEAEENGAV

SEQ ID NO: 85 - protein, 16 aa, Artificial Sequence
  Synthetic
  MISC_FEATURE (1)..(1): optionally absent
MGNTKSGALSKEILEE

SEQ ID NO: 86 - protein, 16 aa, Artificial Sequence
  Synthetic
  MISC_FEATURE (1)..(1): optionally absent
MGKQNSKLRPEVLQDL

SEQ ID NO: 87 - protein, 16 aa, Artificial Sequence
  Synthetic
  MISC_FEATURE (1)..(1): optionally absent
MGAQFSKTAAKGEATA

SEQ ID NO: 88 - protein, 16 aa, Artificial Sequence
  Synthetic
  MISC_FEATURE (1)..(1): optionally absent
MGSQSSKAPRGDVTAE

SEQ ID NO: 89 - protein, 16 aa, Artificial Sequence
  Synthetic
  MISC_FEATURE (1)..(1): optionally absent
MGNRHAKASSPQGFDV

SEQ ID NO: 90 - protein, 16 aa, Artificial Sequence
  Synthetic
  MISC_FEATURE (1)..(1): optionally absent
MGQDQTKQQIEKGLQL

SEQ ID NO: 91 - protein, 16 aa, Artificial Sequence
  Synthetic
  MISC_FEATURE (1)..(1): optionally absent
MGQALSIKSCDFHAAE

SEQ ID NO: 92 - protein, 16 aa, Artificial Sequence
  Synthetic
  MISC_FEATURE (1)..(1): optionally absent
MGNRAFKAHNGHYLSA

SEQ ID NO: 93 - protein, 16 aa, Artificial Sequence
  Synthetic
  MISC_FEATURE (1)..(1): optionally absent
MGARASVLSGGELDRW

SEQ ID NO: 94 - protein, 16 aa, Artificial Sequence
  Synthetic
  MISC_FEATURE (1)..(1): optionally absent
MGQTVTTPLSLTLDHW

SEQ ID NO: 95 - protein, 16 aa, Artificial Sequence
  Synthetic
  MISC_FEATURE (1)..(1): optionally absent
MGQAVTTPLSLTLDHW

SEQ ID NO: 96 - protein, 16 aa, Artificial Sequence
  Synthetic
  MISC_FEATURE (1)..(1): optionally absent
MGNSPSYNPPAGISPS

SEQ ID NO: 97 - protein, 16 aa, Artificial Sequence
  Synthetic
  MISC_FEATURE (1)..(1): optionally absent
MGQTLTTPLSLTLTHF

SEQ ID NO: 98 - protein, 16 aa, Artificial Sequence
  Synthetic
  MISC_FEATURE (1)..(1): optionally absent
MGQTITTPLSLTLDHW

SEQ ID NO: 99 - protein, 16 aa, Artificial Sequence
  Synthetic
  MISC_FEATURE (1)..(1): optionally absent
MGQTVTTPLSLTLEHW

SEQ ID NO: 100 - protein, 16 aa, Artificial Sequence
  Synthetic
  MISC_FEATURE (1)..(1): optionally absent
MGQELSQHERYVEQLK

SEQ ID NO: 101 - protein, 16 aa, Artificial Sequence
  Synthetic
  MISC_FEATURE (1)..(1): optionally absent
MGVSGSKGQKLFVSVL

SEQ ID NO: 102 - protein, 16 aa, Artificial Sequence
  Synthetic
  MISC_FEATURE (1)..(1): optionally absent
MGGKWSKSSVVGWPTV

SEQ ID NO: 103 - protein, 16 aa, Artificial Sequence
  Synthetic
  MISC_FEATURE (1)..(1): optionally absent
MGQHPAKSMDVRRIEG

SEQ ID NO: 104 - protein, 16 aa, Artificial Sequence
  Synthetic
  MISC_FEATURE (1)..(1): optionally absent
MGAQVSRQNVGTHSTQ

SEQ ID NO: 105 - protein, 16 aa, Artificial Sequence
  Synthetic
  MISC_FEATURE (1)..(1): optionally absent
MGLAFSGARPCCCRHN

SEQ ID NO: 106 - protein, 16 aa, Artificial Sequence
  Synthetic
  MISC_FEATURE (1)..(1): optionally absent
MGNRGSSTSSRPPLSS

SEQ ID NO: 107 - protein, 16 aa, Artificial Sequence
  Synthetic
  MISC_FEATURE (1)..(1): optionally absent
MGSYFVPPANYFFKDI

SEQ ID NO: 108 - protein, 16 aa, Artificial Sequence
  Synthetic
  MISC_FEATURE (1)..(1): optionally absent
MGAQLSTLSRVVLSPV

SEQ ID NO: 109 - protein, 16 aa, Artificial Sequence
  Synthetic
  MISC_FEATURE (1)..(1): optionally absent
MGNLKSVGQEPGPPCG

SEQ ID NO: 110 - protein, 16 aa, Artificial Sequence
  Synthetic
  MISC_FEATURE (1)..(1): optionally absent
MGSKRSVPSRHRSLTT

SEQ ID NO: 111 - protein, 16 aa, Artificial Sequence
  Synthetic
  MISC_FEATURE (1)..(1): optionally absent
MGNGESQLSSVPAQKL

SEQ ID NO: 112 - protein, 16 aa, Artificial Sequence
  Synthetic
  MISC_FEATURE (1)..(1): optionally absent
MGAHLVRRYLGDASVE

SEQ ID NO: 113 - protein, 16 aa, Artificial Sequence
  Synthetic
  MISC_FEATURE (1)..(1): optionally absent
MGGKLSKKKKGYNVND

SEQ ID NO: 114 - protein, 16 aa, Artificial Sequence
  Synthetic
  MISC_FEATURE (1)..(1): optionally absent
MGSCCSCPDKDTVPDN

SEQ ID NO: 115 - protein, 16 aa, Artificial Sequence
  Synthetic
  MISC_FEATURE (1)..(1): optionally absent
MGSSEVSIIPGLQKEE

SEQ ID NO: 116 - protein, 16 aa, Artificial Sequence
  Synthetic
  MISC_FEATURE (1)..(1): optionally absent
MLCCMRRTKQVEKNDE

SEQ ID NO: 117 - protein, 15 aa, Artificial Sequence
  Synthetic
  MISC_FEATURE (1)..(1): optionally absent
MGCLGNSKTEDQRNE

SEQ ID NO: 118 - protein, 18 aa, Artificial Sequence
  Synthetic
  MISC_FEATURE (1)..(1): optionally absent
MTLESIMACCLSEEAKEA

SEQ ID NO: 119 - protein, 18 aa, Artificial Sequence
  Synthetic
  MISC_FEATURE (1)..(1): optionally absent
MSGVVRTLSRCLLPAEAG

SEQ ID NO: 120 - protein, 19 aa, Artificial Sequence
  Synthetic
  MISC_FEATURE (1)..(1): optionally absent
MADFLPSRSVCFPGCVLTN

SEQ ID NO: 121 - protein, 21 aa, Artificial Sequence
  Synthetic
  MISC_FEATURE (1)..(1): optionally absent
MARSLRWRCCPWCLTEDEKAA

SEQ ID NO: 122 - protein, 25 aa, Artificial Sequence
  Synthetic
  MISC_FEATURE (1)..(1): optionally absent
MLCCMRRTKQVEKNDDDQKIEQDGI

SEQ ID NO: 123 - protein, 14 aa, Artificial Sequence
  Synthetic
  MISC_FEATURE (1)..(1): optionally absent
MQCCGLVHRRRVRV

SEQ ID NO: 124 - protein, 20 aa, Artificial Sequence
  Synthetic
  MISC_FEATURE (1)..(1): optionally absent
MDCLCIVTTKKYRYQDEDTP

SEQ ID NO: 125 - protein, 20 aa, Artificial Sequence
  Synthetic
  MISC_FEATURE (1)..(1): optionally absent
MCKGLAGLPASCLRSAKDMK

SEQ ID NO: 126 - protein, 16 aa, Artificial Sequence
  Synthetic
  MISC_FEATURE (1)..(1): optionally absent
MGCIKSKEDKGPAMKY

SEQ ID NO: 127 - protein, 16 aa, Artificial Sequence
  Synthetic
  MISC_FEATURE (1)..(1): optionally absent
MGCVQCKDKEATKLTE

SEQ ID NO: 128 - protein, 16 aa, Artificial Sequence
  Synthetic
  MISC_FEATURE (1)..(1): optionally absent
MGCIKSKRKDNLNDDE

SEQ ID NO: 129 - protein, 16 aa, Artificial Sequence
  Synthetic
  MISC_FEATURE (1)..(1): optionally absent
MGCVCSSNPEDDWMEN

SEQ ID NO: 130 - protein, 16 aa, Artificial Sequence
  Synthetic
  MISC_FEATURE (1)..(1): optionally absent
MGCMKSKFLQVGGNTG

SEQ ID NO: 131 - protein, 16 aa, Artificial Sequence
  Synthetic
  MISC_FEATURE (1)..(1): optionally absent
MGCVFCKKLEPVATAK

SEQ ID NO: 132 - protein, 16 aa, Artificial Sequence
  Synthetic
  MISC_FEATURE (1)..(1): optionally absent
MGCVHCKEKISGKGQG

SEQ ID NO: 133 - protein, 16 aa, Artificial Sequence
  Synthetic
  MISC_FEATURE (1)..(1): optionally absent
MGCTLSAEDKAAVERS

SEQ ID NO: 134 - protein, 16 aa, Artificial Sequence
  Synthetic
  MISC_FEATURE (1)..(1): optionally absent
MGCTLSAEERAALERS

SEQ ID NO: 135 - protein, 16 aa, Artificial Sequence
  Synthetic
  MISC_FEATURE (1)..(1): optionally absent
MGCRQSSEEKEAARRS

SEQ ID NO: 136 - protein, 15 aa, Artificial Sequence
  Synthetic
  MISC_FEATURE (1)..(1): optionally absent
MGQLCCFPFSRDEGK

SEQ ID NO: 137 - protein, 28 aa, Artificial Sequence
  Synthetic
  MISC_FEATURE (1)..(1): optionally absent
MGNLKSVGQEPGPPCGLGLGLGLGLCGK

SEQ ID NO: 138 - protein, 13 aa, Artificial Sequence
  Synthetic
SGPGCMSCKCVLS

SEQ ID NO: 139 - protein, 13 aa, Artificial Sequence
  Synthetic
GTQGCMGLPCVVM

SEQ ID NO: 140 - protein, 13 aa, Artificial Sequence
  Synthetic
TPGCVKIKKCVIM

SEQ ID NO: 141 - protein, 13 aa, Artificial Sequence
  Synthetic
DMKKHRCKCCSIM

SEQ ID NO: 142 - protein, 17 aa, Artificial Sequence
  Synthetic
SKDGKKKKKSKTKCVIM

SEQ ID NO: 143 - protein, 14 aa, Artificial Sequence
  Synthetic
KKKKKKSKTKCVIM

SEQ ID NO: 144 - protein, 8 aa, Artificial Sequence
  Synthetic
SKTKCVIM

SEQ ID NO: 145 - protein, 130 aa, Artificial Sequence
  Synthetic
HGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 146 - protein, 140 aa, Artificial Sequence
  Synthetic
  MISC_FEATURE (1)..(1): optionally absent
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 147 - protein, 140 aa, Artificial Sequence
  Synthetic
  MISC_FEATURE (1)..(1): optionally absent
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADVQHWVQGLRKIIDRSGSMDQRQK

SEQ ID NO: 148 - protein, 140 aa, Artificial Sequence
  Synthetic
  MISC_FEATURE (1)..(1): optionally absent
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQK

SEQ ID NO: 149 - protein, 130 aa, Artificial Sequence
  Synthetic
HGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQK

SEQ ID NO: 150 - protein, 178 aa, Artificial Sequence
  Synthetic
  MISC_FEATURE (1)..(1): optionally absent
MSGGKYVDSEGHLYTVPIREQGNIYKPNNKAMAEEMNEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTFCDPLFEAIGKIFSNIRINTQKEI

SEQ ID NO: 151 - protein, 178 aa, Artificial Sequence
  Synthetic
  MISC_FEATURE (1)..(1): optionally absent
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 152 - protein, 4 aa, Artificial Sequence
  Synthetic
  MISC_FEATURE (2)..(2): Xaa is T or S
PXAP

SEQ ID NO: 153 - protein, 9 aa, Artificial Sequence
  Synthetic
  MISC_FEATURE (1)..(1): Xaa is a hydrophobic residue
  MISC_FEATURE (3)..(4): X is any amino acid or absent
  MISC_FEATURE (5)..(5): or a hydrophobic residue
  MISC_FEATURE (6)..(8): X is any amino acid or absent
  MISC_FEATURE (9)..(9): Xaa is L or I
XYXXPXXXX

SEQ ID NO: 154 - protein, 4 aa, Artificial Sequence
  Synthetic
  MISC_FEATURE (3)..(3): Xaa is any amino acid
PPXY

SEQ ID NO: 155 - protein, 7 aa, Artificial Sequence
  Synthetic
  MISC_FEATURE (2)..(2): Xaa is T or S
  MISC_FEATURE (6)..(6): Xaa is any amino acid
PXAPPXY

SEQ ID NO: 156 - protein, 8 aa, Artificial Sequence
  Synthetic
  MISC_FEATURE (2)..(2): Xaa is T or S
  MISC_FEATURE (7)..(7): Xaa is any amino acid
PXAPYPXL

SEQ ID NO: 157 - protein, 8 aa, Artificial Sequence
  Synthetic
  MISC_FEATURE (3)..(3): Xaa is any amino acid
  MISC_FEATURE (6)..(6): Xaa is T or S
PPXYPXAP

SEQ ID NO: 158 - protein, 8 aa, Artificial Sequence
  Synthetic
  MISC_FEATURE (3)..(3): Xaa is any amino acid
  MISC_FEATURE (7)..(7): Xaa is any amino acid
PPXYYPXL

SEQ ID NO: 159 - protein, 8 aa, Artificial Sequence
  Synthetic
  MISC_FEATURE (3)..(3): Xaa is any amino acid
  MISC_FEATURE (7)..(7): Xaa is any amino acid
YPXLPPXY

SEQ ID NO: 160 - protein, 8 aa, Artificial Sequence
  Synthetic
  MISC_FEATURE (3)..(3): Xaa is any amino acid
  MISC_FEATURE (7)..(7): Xaa is any amino acid
YPXLPPXY

SEQ ID NO: 161 - protein, 7 aa, Artificial Sequence
  Synthetic
PTAPPEE

SEQ ID NO: 162 - protein, 6 aa, Artificial Sequence
  Synthetic
YPLTSL

SEQ ID NO: 163 - protein, 7 aa, Artificial Sequence
  Synthetic
PTAPPEY

SEQ ID NO: 164 - protein, 4 aa, Artificial Sequence
  Synthetic
YPDL

SEQ ID NO: 165 - protein, 4 aa, Artificial Sequence
  Synthetic
FPIV

SEQ ID NO: 166 - protein, 7 aa, Artificial Sequence
  Synthetic
PTAPPEY

SEQ ID NO: 167 - protein, 4 aa, Artificial Sequence
  Synthetic
PTAP

SEQ ID NO: 168 - protein, 4 aa, Artificial Sequence
  Synthetic
PPEY

SEQ ID NO: 169 - protein, 6 aa, Artificial Sequence
  Synthetic
YPLTSL

SEQ ID NO: 170 - protein, 18 aa, Artificial Sequence
  Synthetic
AAGAYDPARKLLEQYAKK

SEQ ID NO: 171 - protein, 80 aa, Artificial Sequence
  Synthetic
PNCFNSSINNIHEMEIQLKDALEKNQQWLVYDQQREVYVKGLLAKIFELEKKTETAAHSLPQQTKKPESEGYLQEEKQKC

SEQ ID NO: 172 - protein, 52 aa, Artificial Sequence
  Synthetic
LQSRPEPTAPPEESFRSGVETTTPPQKQEPIDKELYPLTSLRSLFGNDPSSQ

SEQ ID NO: 173 - protein, 20 aa, Artificial Sequence
  Synthetic
RRVILPTAPPEYMEAIYPVR

SEQ ID NO: 174 - protein, 51 aa, Artificial Sequence
  Synthetic
PIQQKSQHNKSVVQETPQTQNLYPDLSEIKKEYNVKEKDQVEDLNLDSLWE

SEQ ID NO: 175 - protein, 20 aa, Artificial Sequence
  Synthetic
NPRQSIKAFPIVINSDGGEK

SEQ ID NO: 176 - protein, 10 aa, Artificial Sequence
  Synthetic
PTAPPEYGGS

SEQ ID NO: 177 - protein, 7 aa, Artificial Sequence
  Synthetic
PTAPGGS

SEQ ID NO: 178 - protein, 7 aa, Artificial Sequence
  Synthetic
PPEYGGS

SEQ ID NO: 179 - protein, 9 aa, Artificial Sequence
  Synthetic
YPLTSLGGS

SEQ ID NO: 180 - protein, 7 aa, Artificial Sequence
  Synthetic
YPDLGGS

SEQ ID NO: 181 - protein, 7 aa, Artificial Sequence
  Synthetic
FPIVGGS

SEQ ID NO: 182 - protein, 52 aa, Artificial Sequence
  Synthetic
LQSRPEAAAAPEESFRSGVETTTPPQKQEPIDKELYPLTSLRSLFGNDPSSQ

SEQ ID NO: 183 - protein, 4 aa, Artificial Sequence
  Synthetic
  MISC_FEATURE (11)..(13): optionally absent
PTAP

SEQ ID NO: 184 - protein, 52 aa, Artificial Sequence
  Synthetic
LQSRPEPTAPPEESFRSGVETTTPPQKQEPIDKELAALTSLRSLFGNDPSSQ

SEQ ID NO: 185 - protein, 19 aa, Artificial Sequence
  Synthetic
SREKPYKEVTEDLLHLNSL

SEQ ID NO: 186 - protein, 51 aa, Artificial Sequence
  Synthetic
QSRPEPTAPPEESFRSGVETTTPPQKQEPIDKELYPLTSLRSLFGNDPSSQ

SEQ ID NO: 187 - protein, 17 aa, Artificial Sequence
  Synthetic
DPQIPPPPYVEPTAPQV

SEQ ID NO: 188 - protein, 11 aa, Artificial Sequence
  Synthetic
LLTEDPPPYRD

SEQ ID NO: 189 - protein, 11 aa, Artificial Sequence
  Synthetic
TASAPPPPYVG

SEQ ID NO: 190 - protein, 15 aa, Artificial Sequence
  Synthetic
TPQTQNLYPDLSEIK

SEQ ID NO: 191 - protein, 17 aa, Artificial Sequence
  Synthetic
  MISC_FEATURE (1)..(1): optionally absent
MRRVILPTAPPEYMEAI

SEQ ID NO: 192 - protein, 16 aa, Artificial Sequence
  Synthetic
NTYMQYLNPPPYADHS

SEQ ID NO: 193 - protein, 21 aa, Artificial Sequence
  Synthetic
LGIAPPPYEEDTSMEYAPSAP

SEQ ID NO: 194 - protein, 16 aa, Artificial Sequence
  Synthetic
DDLWLPPPEYVPLKEL

SEQ ID NO: 195 - protein, 20 aa, Artificial Sequence
  Synthetic
AAPTAPPTGAADSIPPPYSP

SEQ ID NO: 196 - protein, 11 aa, Artificial Sequence
  Synthetic
TAPSSPPPYEE

SEQ ID NO: 197 - protein, 14 aa, Artificial Sequence
  Synthetic
QSIKAFPIVINSDG

SEQ ID NO: 198 - protein, 22 aa, Artificial Sequence
  Synthetic
DRRRRGSRPSGAERRRRRAAAA

SEQ ID NO: 199 - protein, 97 aa, Artificial Sequence
  Synthetic
AVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 200 - protein, 55 aa, Artificial Sequence
  Synthetic
  MISC_FEATURE (1)..(1): optionally absent
MQKGNFRNQRKTVKCFNCGKEGHIAKNCRAPRKKGCWKCGKEGHQMKDCTERQAN

SEQ ID NO: 201 - protein, 14 aa, Artificial Sequence
  Synthetic
RPRGTRGKGRRIRR

SEQ ID NO: 202 - protein, 96 aa, Artificial Sequence
  Synthetic
EQAPEDQGPQREPHNEWTLELLEELKREAVRHFPRPWLHGLGQHIYETYGDTWAGVEAIIRILQQLLFIHFRIGCQHSRIGIIQQRRARRNGASRS

SEQ ID NO: 203 - protein, 384 aa, Artificial Sequence
  Synthetic
  MISC_FEATURE (1)..(1): optionally absent
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHWGSEQAPEDQGPQREPHNEWTLELLEELKREAVRHFPRPWLHGLGQHIYETYGDTWAGVEAIIRILQQLLFIHFRIGCQHSRIGIIQQRRARRNGASRS

SEQ ID NO: 204 - RNA, 32 nt, Artificial Sequence
  Synthetic
ggucugggcgcacuucggugacgguacaggcc

SEQ ID NO: 205 - RNA, 21 nt, Artificial Sequence
  Synthetic
aauccauugcacuccggauuu

SEQ ID NO: 206 - RNA, 44 nt, Artificial Sequence
  Synthetic
ggcgacuggugaguacgccaaaaauuuugacuagcggaggcuag

SEQ ID NO: 207 - RNA, 28 nt, Artificial Sequence
  Synthetic
ggcucguguagcucauuagcuccgagcc

SEQ ID NO: 208 - RNA, 972 nt, Artificial Sequence
  Synthetic
ggucugggcgcacuucggugacgguacaggccuaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggucugggcgcacuucggugacgguacaggcc

SEQ ID NO: 209 - RNA, 950 nt, Artificial Sequence
  Synthetic
aauccauugcacuccggauuuuaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugaauccauugcacuccggauuu

SEQ ID NO: 210 - RNA, 996 nt, Artificial Sequence
  Synthetic
ggcgacuggugaguacgccaaaaauuuugacuagcggaggcuaguaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcgacuggugaguacgccaaaaauuuugacuagcggaggcuag

SEQ ID NO: 211 - RNA, 964 nt, Artificial Sequence
  Synthetic
ggcucguguagcucauuagcuccgagccuaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcucguguagcucauuagcuccgagcc

SEQ ID NO: 212 - RNA, 978 nt, Artificial Sequence
  Synthetic
ggucugggcgcacuucggugacgguacaggccuaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggucugggcgcacuucggugacgguacaggcc

SEQ ID NO: 213 - RNA, 956 nt, Artificial Sequence
  Synthetic
aauccauugcacuccggauuuuaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugaauccauugcacuccggauuu

SEQ ID NO: 214 - RNA, 1002 nt, Artificial Sequence
  Synthetic
ggcgacuggugaguacgccaaaaauuuugacuagcggaggcuaguaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcgacuggugaguacgccaaaaauuuugacuagcggaggcuag

SEQ ID NO: 215 - RNA, 970 nt, Artificial Sequence
  Synthetic
ggcucguguagcucauuagcuccgagccuaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcucguguagcucauuagcuccgagcc

SEQ ID NO: 216 - RNA, 897 nt, Artificial Sequence
  Synthetic
ggucugggcgcacuucggugacgguacaggccuaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaacgagcacacauccuauuugggccuagcaaccaacaguaugggucugggcgcacuucggugacgguacaggcc

SEQ ID NO: 217 - RNA, 875 nt, Artificial Sequence
  Synthetic
aauccauugcacuccggauuuuaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaagcuccacacauccuauuugggccuagcaaccaacaguaugaauccauugcacuccggauuu

SEQ ID NO: 218 - RNA, 921 nt, Artificial Sequence
  Synthetic
ggcgacuggugaguacgccaaaaauuuugacuagcggaggcuaguaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaacagccacacauccuauuugggccuagcaaccaacaguaugggcgacuggugaguacgccaaaaauuuugacuagcggaggcuag

SEQ ID NO: 219 - RNA, 889 nt, Artificial Sequence
  Synthetic
ggcucguguagcucauuagcuccgagccuaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaagucgcacacauccuauuugggccuagcaaccaacaguaugggcucguguagcucauuagcuccgagcc

SEQ ID NO: 220 - protein, 274 aa, Artificial Sequence
  Synthetic
  MISC_FEATURE (1)..(1): optionally absent
  MISC_FEATURE (2)..(9): Myc tag optionally absent
MDYKDDDDKGSDPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 221 - protein, 276 aa, Artificial Sequence
  Synthetic
  MISC_FEATURE (1)..(1): optionally absent
  MISC_FEATURE (3)..(11): Myc tag optionally absent
MEQKLISEEDLGSDPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 222 - protein, 249 aa, Artificial Sequence
  Synthetic
  MISC_FEATURE (1)..(1): optionally absent
  MISC_FEATURE (3)..(11): Myc tag optionally absent
MEQKLISEEDLVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 223 - protein, 4 aa, Artificial Sequence
  Synthetic
GSGS

SEQ ID NO: 224 - protein, 10 aa, Artificial Sequence
  Synthetic
GSDGSGRSGS

SEQ ID NO: 225 - protein, 12 aa, Artificial Sequence
  Synthetic
GSKSGSGSDSGS

SEQ ID NO: 226 - protein, 22 aa, Artificial Sequence
  Synthetic
GSGSGDGGRGSRGGDGSGGSSG

SEQ ID NO: 227 - protein, 282 aa, Artificial Sequence
  Synthetic
  MISC_FEATURE (1)..(1): optionally absent
  MISC_FEATURE (222)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 228 - protein, 380 aa, Artificial Sequence
  Synthetic
  MISC_FEATURE (1)..(22): optionally absent
  MISC_FEATURE (370)..(378): FLAG tag- optionally absent
MVRRVILPTAPPEYMEAIYPVRGSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEGSDGSGRSGSHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKDYKDDDDKGS

SEQ ID NO: 229 - protein, 282 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQ

SEQ ID NO: 230 - protein, 282 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 231 - protein, 282 aa, Artificial Sequence
  Synthetic
  MISC_FEATURE (1)..(1): optionally absent
  MISC_FEATURE (223)..(231): Myc tag-optionally absent
MGAQFSGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 232 - protein, 289 aa, Artificial Sequence
  Synthetic
  MISC_FEATURE (1)..(1): optionally absent
  MISC_FEATURE (230)..(238): Myc tag-optionally absent
MGCIKSKRKDNLNGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 233 - protein, 289 aa, Artificial Sequence
  Synthetic
  MISC_FEATURE (1)..(1): optionally absent
  MISC_FEATURE (230)..(238): Myc tag-optionally absent
MGCTLSAEERAALGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 234 - protein, 289 aa, Artificial Sequence
  Synthetic
  MISC_FEATURE (1)..(1): optionally absent
  MISC_FEATURE (230)..(238): Myc tag-optionally absent
MLCCMRRTKQVEKGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 235 - protein, 278 aa, Artificial Sequence
  Synthetic
  MISC_FEATURE (1)..(1): optionally absent
  MISC_FEATURE (270)..(278): Myc tag-optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDL

SEQ ID NO: 236 - protein, 399 aa, Artificial Sequence
  Synthetic
  MISC_FEATURE (1)..(1): optionally absent
  MISC_FEATURE (340)..(348): Myc tag-optionally absent
MHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 237 - protein, 368 aa, Artificial Sequence
  Synthetic
  MISC_FEATURE (1)..(1): optionally absent
  MISC_FEATURE (230)..(238): Myc tag-optionally absent
MRRVILPTAPPEYMEAIYPVRGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 238 - protein, 400 aa, Artificial Sequence
  Synthetic
  MISC_FEATURE (1)..(1): optionally absent
  MISC_FEATURE (392)..(400): Myc tag-optionally absent
MLQSRPEPTAPPEESFRSGVETTTPPQKQEPIDKELYPLTSLRSLFGNDPSSQHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDL

SEQ ID NO: 239 - protein, 396 aa, Artificial Sequence
  Synthetic
  MISC_FEATURE (1)..(1): optionally absent
  MISC_FEATURE (388)..(396): Myc tag-optionally absent
MHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDL

SEQ ID NO: 240 - protein, 395 aa, Artificial Sequence
  Synthetic
  MISC_FEATURE (1)..(1): optionally absent
  MISC_FEATURE (206)..(214): Myc tag-optionally absent
MKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 241 - protein, 251 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLRRVILPTAPPEYMEAIYPVR

SEQ ID NO: 242 - protein, 282 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLPIQQKSQHNKSVVQETPQTQNLYPDLSEIKKEYNVKEKDQVEDLNLDSLWE

SEQ ID NO: 243 - protein, 251 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLNPRQSIKAFPIVINSDGGEK

SEQ ID NO: 244 - protein, 305 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGLQSRPEPTAPPEESFRSGVETTTPPQKQEPIDKELYPLTSLRSLFGNDPSSQ

SEQ ID NO: 245 - protein, 304 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGPIQQKSQHNKSVVQETPQTQNLYPDLSEIKKEYNVKEKDQVEDLNLDSLWE

SEQ ID NO: 246 - protein, 273 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGNPRQSIKAFPIVINSDGGEK

SEQ ID NO: 247 - protein, 263 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGPTAPPEYGGS

SEQ ID NO: 248 - protein, 260 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGPTAPGGS

SEQ ID NO: 249 - protein, 262 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGYPLTSLGGS

SEQ ID NO: 250 - protein, 260 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGYPDLGGS

SEQ ID NO: 251 - protein, 260 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGFPIVGGS

SEQ ID NO: 252 - protein, 375 aa, Artificial Sequence
  Synthetic
  MISC_FEATURE (1)..(1): optionally absent
  MISC_FEATURE (237)..(245): Myc tag-optionally absent
MLQSRPEPTAPPEESFRSGVETTTPPQKQEPIDKELYPLTSLRSLFGNDPSSQSQAIGILELTSIAAGMELGDAMLKSANVDLLVSKTISPGKFLLMLGGDIGAIQQAIETGTSQAGELLVDSLVLANIHPSVLPAISGLNSVDKRQAVGIVETWSVAACISAADRAVKGSNVTLVRVHMAFGIGGKCYMVVAGDVSDVALAVTVASSSAGAYGLLVYASLIPRPHEAMWRQMVEGQKLISEEDLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 253 - protein, 634 aa, Artificial Sequence
  Synthetic
  MISC_FEATURE (1)..(1): optionally absent
  MISC_FEATURE (575)..(583): Myc tag-optionally absent
MHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 254 - protein, 311 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSDRRRRGSRPSGAERRRRRAAAA

SEQ ID NO: 255 - protein, 329 aa, Artificial Sequence
  Synthetic
  MISC_FEATURE (1)..(1): optionally absent
  MISC_FEATURE (223)..(231): myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSDRRRRGSRPSGAERRRRRAAAA

SEQ ID NO: 256 - protein, 310 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSDRRRRGSRPSGAERRRRRAAAA

SEQ ID NO: 257 - protein, 328 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSDRRRRGSRPSGAERRRRRAAAA

SEQ ID NO: 258 - protein, 386 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 259 - protein, 404 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 260 - protein, 385 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 261 - protein, 403 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 262 - protein, 344 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSMQKGNFRNQRKTVKCFNCGKEGHIAKNCRAPRKKGCWKCGKEGHQMKDCTERQAN

SEQ ID NO: 263 - protein, 362 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSMQKGNFRNQRKTVKCFNCGKEGHIAKNCRAPRKKGCWKCGKEGHQMKDCTERQAN

SEQ ID NO: 264 - protein, 343 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSMQKGNFRNQRKTVKCFNCGKEGHIAKNCRAPRKKGCWKCGKEGHQMKDCTERQAN

SEQ ID NO: 265 - protein, 361 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSMQKGNFRNQRKTVKCFNCGKEGHIAKNCRAPRKKGCWKCGKEGHQMKDCTERQAN

SEQ ID NO: 266 - protein, 303 aa, Artificial Sequence
  Synthetic
  MISC_FEATURE (1)..(1): optionally absent
  MISC_FEATURE (223)..(231): Myc Tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSRPRGTRGKGRRIRR

SEQ ID NO: 267 - protein, 321 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSRPRGTRGKGRRIRR

SEQ ID NO: 268 - protein, 302 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSRPRGTRGKGRRIRR

SEQ ID NO: 269 - protein, 320 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSRPRGTRGKGRRIRR

SEQ ID NO: 270 - protein, 207 aa, Artificial Sequence
  Synthetic
MEGMDPLAVLAESRLLPLLTVRGGEDLAGLATVLELMGVGALEITLRTEKGLEALKALRKSGLLLGAGTVRSPKEAEAALEAGAAFLVSPGLLEEVAALAQARGVPYLPGVLTPTEVERALALGLSALKFFPAEPFQGVRVLRAYAEVFPEVRFLPTGGIKEEHLPHYAALPNLLAVGGSWLLQGDLAAVMKKVKAAKALLSPQAPG

SEQ ID NO: 271 - protein, 156 aa, Artificial Sequence
  Synthetic
MTKKVGIVDTTFARVDMAEAAIRTLKALSPNIKIIRKTVPGIKDLPVACKKLLEEEGCDIVMALGMPGKAEKDKVCAHEASLGLMLAQLMTNKHIIEVFVHEDEAKDDDELDILALVRAIEHAANVYYLLFKPEYLTRMAGKGLRQGREDAGPARE

SEQ ID NO: 272 - protein, 156 aa, Artificial Sequence
  Synthetic
MTKKVGIVDTTFARVDMASAAILTLKMESPNIKIIRKTVPGIKDLPVACKKLLEEEGCDIVMALGMPGKAEKDKVCAHEASLGLMLAQLMTNKHIIEVFVHEDEAKDDAELKILAARRAIEHALNVYYLLFKPEYLTRMAGKGLRQGFEDAGPARE

SEQ ID NO: 273 - protein, 209 aa, Artificial Sequence
  Synthetic
MSTINNQLKALKVIPVIAIDNAEDIIPLGKVLAENGLPAAEITFRSSAAVKAIMLLRSAQPEMLIGAGTILNGVQALAAKEAGATFVVSPGFNPNTVRACQIIGIDIVPGVNNPSTVEAALEMGLTTLKFFPAEASGGISMVKSLVGPYGDIRLMPTGGITPSNIDNYLAIPQVLACGGTWMVDKKLVTNGEWDEIARLTREIVEQVNP

SEQ ID NO: 274 - protein, 114 aa, Artificial Sequence
  Synthetic
MPIFTLNTNIKATDVPSDFLSLTSRLVGLILSKPGSYVAVHINTDQQLSFGGSTNPAAFGTLMSIGGIEPSKNRDHSAVLFDHLNAMLGIPKNRMYIHFVNLNGDDVGWNGTTF

SEQ ID NO: 275 - protein, 157 aa, Artificial Sequence
  Synthetic
MNQHSHKDYETVRIAVVRARWHADIVDACVEAFEIAMAAIGGDRFAVDVFDVPGAYEIPLHARTLAETGRYGAVLGTAFVVNGGIYRHEFVASAVIDGMMNVQLSTGVPVLSAVLTPHRYRDSAEHHRFFAAHFAVKGVEAARACIEILAAREKIAA

SEQ ID NO: 276 - protein, 205 aa, Artificial Sequence
  Synthetic
MKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTE

SEQ ID NO: 277 - protein, 157 aa, Artificial Sequence
  Synthetic
MNQHSHKDYETVRIAVVRARWHAEIVDACVSAFEAAMADIGGDRFAVDVFDVPGAYEIPLHARTLAETGRYGAVLGTAFVVNGGIYRHEFVASAVIDGMMNVQLSTGVPVLSAVLTPHRYRDSDAHTLLFLALFAVKGMEAARACVEILAAREKIAA

SEQ ID NO: 278 - protein, 177 aa, Artificial Sequence
  Synthetic
MFTKSGDDGNTNVINKRVGKDSPLVNFLGDLDELNSFIGFAISKIPWEDMKKDLERVQVELFEIGEDLSTQSSKKKIDESYVLWLLAATAIYRIESGPVKLFVIPGGSEEASVLHVTRSVARRVERNAVKYTKELPEINRMIIVYLNRLSSLLFAMALVANKRRNQSEKIYEIGKSW

SEQ ID NO: 279 - protein, 157 aa, Artificial Sequence
  Synthetic
MNQHSHKDYETVRIAVVRARWHADIVDQCVRAFEEAMADAGGDRFAVDVFDVPGAYEIPLHARTLAETGRYGAVLGTAFVVNGGIYRHEFVASAVIDGMMNVQLSTGVPVLSAVLTPHRYRSSREHHEFFREHFMVKGVEAAAACITILAAREKIAA

SEQ ID NO: 280 - protein, 6 aa, Artificial Sequence
  Synthetic
  MISC_FEATURE (1)..(1): optionally absent
MGARAS

SEQ ID NO: 281 - protein, 6 aa, Artificial Sequence
  Synthetic
  MISC_FEATURE (1)..(1): optionally absent
MGAQFS

SEQ ID NO: 282 - protein, 6 aa, Artificial Sequence
  Synthetic
  MISC_FEATURE (1)..(1): optionally absent
MGSSKS

SEQ ID NO: 283 - protein, 6 aa, Artificial Sequence
  Synthetic
  MISC_FEATURE (1)..(1): optionally absent
MGKQNS

SEQ ID NO: 284 - protein, 13 aa, Artificial Sequence
  Synthetic
  MISC_FEATURE (1)..(1): optionally absent
MGCIKSKRKDNLN

SEQ ID NO: 285 - protein, 13 aa, Artificial Sequence
  Synthetic
  MISC_FEATURE (1)..(1): optionally absent
MGCTLSAEERAAL

SEQ ID NO: 286 - protein, 13 aa, Artificial Sequence
  Synthetic
  MISC_FEATURE (1)..(1): optionally absent
MLCCMRRTKQVEK

SEQ ID NO: 287 - protein, 13 aa, Artificial Sequence
  Synthetic
  MISC_FEATURE (1)..(1): optionally absent
MDCLCIVTTKKYR

SEQ ID NO: 288 - protein, 13 aa, Artificial Sequence
  Synthetic
KKKKKSKTKCVIM

SEQ ID NO: 289 - protein, 13 aa, Artificial Sequence
  Synthetic
DMKKHRCKCCSIM

SEQ ID NO: 290 - protein, 13 aa, Artificial Sequence
  Synthetic
AQRQKKRRLCLLL

SEQ ID NO: 291 - protein, 13 aa, Artificial Sequence
  Synthetic
AQEFIHQFLCNPL

SEQ ID NO: 292 - protein, 130 aa, Artificial Sequence; identical to SEQ ID NO: 145
  Synthetic

SEQ ID NO: 293 - protein, 52 aa, Artificial Sequence
  Synthetic
PHRFKVHNYMSPTFCDHCGSLLWGLVKQGLKCEDCGMNVHHKCREKVANLCG

SEQ ID NO: 294 - protein, 126 aa, Artificial Sequence
  Synthetic
GAVKLSVSYRNGTLFIMVMHIKDLVTEDGADPNPYVKTYLLPDTHKTSKRKTKISRKTRNPTFNEMLVYSGYSKETLRQRELQLSVLSAESLRENFFLGGITLPLKDFNLSKETVKWYQLTAATYL

SEQ ID NO: 295 - protein, 148 aa, Artificial Sequence
  Synthetic
AVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRR

SEQ ID NO: 296 - protein, 13 aa, Artificial Sequence
  Synthetic
  MISC_FEATURE (1)..(1): optionally absent
MGCIKSKGKDSLS

SEQ ID NO: 297 - protein, 10 aa, Artificial Sequence
  Synthetic
  MISC_FEATURE (1)..(1): optionally absent
MGCINSKRKD

SEQ ID NO: 298 - protein, 16 aa, Artificial Sequence
  Synthetic
  MISC_FEATURE (1)..(1): optionally absent
MGSSKSKPKDPSQRRR

SEQ ID NO: 299 - protein, 16 aa, Artificial Sequence
  Synthetic
  MISC_FEATURE (1)..(1): optionally absent
MGCIKSKEDKGPAMKY

SEQ ID NO: 300 - protein, 6 aa, Artificial Sequence
  Synthetic
  MISC_FEATURE (1)..(1): optionally absent
  MISC_FEATURE (3)..(5): Xaa is any amino acid
  MISC_FEATURE (6)..(6): Xaa is T or S
MGXXXX

SEQ ID NO: 301 - protein, 4 aa, Artificial Sequence
  Synthetic
  MISC_FEATURE (3)..(3): Xaa is any amino acid
YPXL

SEQ ID NO: 302 - protein, 6 aa, Artificial Sequence
  Synthetic
YPLTSL

SEQ ID NO: 303 - protein, 4 aa, Artificial Sequence
  Synthetic
PTAP

SEQ ID NO: 304 - protein, 205 aa, Artificial Sequence
  Synthetic
  MISC_FEATURE (1)..(1): optionally absent
MKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTE

SEQ ID NO: 305 - protein, 18 aa, Artificial Sequence
  Synthetic
RKSPTPSAPVPLTEPAAQ

SEQ ID NO: 306 - protein, 62 aa, Artificial Sequence
  Synthetic
  MISC_FEATURE (1)..(1): optionally absent
MSLYPSLEDLKVDKVIQAQTAFSANPANPAILSEASAPIPHDGNLYPRLYPELSQYMGLSLN

SEQ ID NO: 307 - protein, 511 aa, Artificial Sequence
  Synthetic
  MISC_FEATURE (1)..(1): optionally absent
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 308 - protein, 665 aa, Artificial Sequence
  Synthetic
  MISC_FEATURE (1)..(1): optionally absent
MARSTLSKPLKNKVNPRGPLIPLILLMLRGVSTASPGSSPHQVYNITWEVTNGDRETVWATSGNHPLWTWWPDLTPDLCMLAHHGPSYWGLEYQSPFSSPPGPPCCSGGSSPGCSRDCEEPLTSLTPRCNTAWNRLKLDQTTHKSNEGFYVCPGPHRPRESKSCGGPDSFYCAYWGCETTGRAYWKPSSSWDFITVNNNLTSDQAVQVCKDNKWCNPLVIRFTDAGRRVTSWTTGHYWGLRLYVSGQDPGLTFGIRLRYQNLGPRVPIGPNPVLADQQPLSKPKPVKSPSVTKPPSGTPLSPTQLPPAGTENRLLNLVDGAYQALNLTSPDKTQECWLCLVAGPPYYEGVAVLGTYSNHTSAPANCSVASQHKLTLSEVTGQGLCIGAVPKTHQALCNTTQTSSRGSYYLVAPTGTMWACSTGLTPCISTTILNLTTDYCVLVELWPRVTYHSPSYVYGLFERSNRHKREPVSLTLALLLGGLTMGGIAAGIGTGTTALMATQQFQQLQAAVQDDLREVEKSISNLEKSLTSLSEVVLQNRRGLDLLFLKEGGLCAALKEECCFYADHTGLVRDSMAKLRERLNQRQKLFESTQGWFEGLFNRSPWFTTLISTIMGPLIVLLMILLFGPCILNRLVQFVKDRISVVQALVLTQQYHQLKPIEYEP

SEQ ID NO: 309 - protein, 654 aa, Artificial Sequence
  Synthetic
  MISC_FEATURE (1)..(1): optionally absent
MARSTLSKPPQDKINPWKPLIVMGVLLGVGMAESPHQVFNVTWRVTNLMTGRTANATSLLGTVQDAFPKLYFDLCDLVGEEWDPSDQEPYVGYGCKYPAGRQRTRTFDFYVCPGHTVKSGCGGPGEGYCGKWGCETTGQAYWKPTSSWDLISLKRGNTPWDTGCSKVACGPCYDLSKVSNSFQGATRGGRCNPLVLEFTDAGKKANWDGPKSWGLRLYRTGTDPITMFSLTRQVLNVGPRVPIGPNPVLPDQRLPSSPIEIVPAPQPPSPLNTSYPPSTTSTPSTSPTSPSVPQPPPGTGDRLLALVKGAYQALNLTNPDKTQECWLCLVSGPPYYEGVAVVGTYTNHSTAPANCTATSQHKLTLSEVTGQGLCMGAVPKTHQALCNTTQSAGSGSYYLAAPAGTMWACSTGLTPCLSTTVLNLTTDYCVLVELWPRVIYHSPDYMYGQLEQRTKYKREPVSLTLALLLGGLTMGGIAAGIGTGTTALIKTQQFEQLHAAIQTDLNEVEKSITNLEKSLTSLSEVVLQNRRGLDLLFLKEGGLCAALKEECCFYADHTGLVRDSMAKLRERLNQRQKLFETGQGWFEGLFNRSPWFTTLISTIMGPLIVLLLILLFGPCILNRLVQFVKDRISVVQALVLTQQYHQLKPIEYEP

SEQ ID NO: 310 - protein, 981 aa, Artificial Sequence
  Synthetic
SAAPLVTAMCLLGNVSFPCDRPPTCYTREPSRALDILEENVNHEAYDTLLNAILRCGSSGRSKRSVIDDFTLTSPYLGTCSYCHHTVPCFSPVKIEQVWDEADDNTIRIQTSAQFGYDQSGAASANKYRYMSLKQDHTVKEGTMDDIKISTSGPCRRLSYKGYFLLAKCPPGDSVTVSIVSSNSATSCTLARKIKPKFVGREKYDLPPVHGKKIPCTVYDRLKETTAGYITMHRPRPHAYTSYLEESSGKVYAKPPSGKNITYECKCGDYKTGTVSTRTEITGCTAIKQCVAYKSDQTKWVFNSPDLIRHDDHTAQGKLHLPFKLIPSTCMVPVAHAPNVIHGFKHISLQLDTDHLTLLTTRRLGANPEPTTEWIVGKTVRNFTVDRDGLEYIWGNHEPVRVYAQESAPGDPHGWPHEIVQHYYHRHPVYTILAVASATVAMMIGVTVAVLCACKARRECLTPYALAPNAVIPTSLALLCCVRSANAETFTETMSYLWSNSQPFFWVQLCIPLAAFIVLMRCCSCCLPFLVVAGAYLAKVDAYEHATTVPNVPQIPYKALVERAGYAPLNLEITVMSSEVLPSTNQEYITCKFTTVVPSPKIKCCGSLECQPAAHADYTCKVFGGVYPFMWGGAQCFCDSENSQMSEAYVELSADCASDHAQAIKVHTAAMKVGLRIVYGNTTSFLDVYVNGVTPGTSKDLKVIAGPISASFTPFDHKVVIHRGLVYNYDFPEYGAMKPGAFGDIQATSLTSKDLIASTDIRLLKPSAKNVHVPYTQASSGFEMWKNNSGRPLQETAPFGCKIAVNPLRAVDCSYGNIPISIDIPNAAFIRTSDAPLVSTVKCEVSECTYSADFGGMATLQYVSDREGQCPVHSHSSTATLQESTVHVLEKGAVTVHFSTASPQANFIVSLCGKKTTCNAECKPPADHIVSTPHKNDQEFQAAISKTSWSWLFALFGGASSLLIIGLMIFACSMMLTSTRR

SEQ ID NO: 311 - protein, 676 aa, Artificial Sequence
  Synthetic
  MISC_FEATURE (1)..(1): optionally absent
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 312 - protein, 853 aa, Artificial Sequence
  Synthetic
  MISC_FEATURE (1)..(1): optionally absent
MRVKEKYQHLWRWGWKWGIMLLGILMICSATENLWVTVYYGVPVWKEATTTLFCASDAKAYDTEVHNVCATHACVPTDPNPQEVILVNVTENFDMWKNDMVEQMHEDIISLWDQSLKPCVKLTPLCVNLKCTDLKNDTNTNSSNGRMIMEKGEIKNCSFNISTSIRNKVQKEYAFFYKLDIRPIDNTTYRLISCNTSVITQACPKVSFEPIPIHYCAPAGFAILKCNDKTFNGTGPCTNVSTVQCTHGIRPVVSTQLLLNGSLAEEEGVIRSANFTDNAKTIIVQLNTSVEINCTRPNNNTRKSIRIQRGPGRAFVTIGKIGNMRQAHCNISRAKWMSTLKQIASKLREQFGNNKTVIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGKNTNESEVFRPGGGDMRDNWRSELYKYKVVKIETLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQFWNNMTWMEWDREINNYTSLIHSLIDESQNQQEKNEQELLELDKWASLWNWFNITNWLWYIKIFIMIVGGLVGLRIVFAVLSIVNRVRQGYSPLSFQTHLPNRGGPDRPEGIEEEGGERDRDRSVRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERIL

SEQ ID NO: 313 - protein, 574 aa, Artificial Sequence
  Synthetic
  MISC_FEATURE (1)..(1): optionally absent
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 314 - protein, 1255 aa, Artificial Sequence
  Synthetic
  MISC_FEATURE (1)..(1): optionally absent
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 315 - protein, 566 aa, Artificial Sequence
  Synthetic
  MISC_FEATURE (1)..(1): optionally absent
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 316 - protein, 4 aa, Artificial Sequence
  Synthetic
AAAA

SEQ ID NO: 317 - protein, 263 aa, Artificial Sequence
  Synthetic
  MISC_FEATURE (1)..(1): optionally absent
  MISC_FEATURE (204)..(212): optionally absent
MEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 318 - protein, 282 aa, Artificial Sequence
  Synthetic
  MISC_FEATURE (1)..(1): optionally absent
  MISC_FEATURE (223)..(231): optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSAAGNDPSSQ

SEQ ID NO: 319 - DNA, 20 bp, Artificial Sequence
  Synthetic
catactgttggttgctaggc

SEQ ID NO: 320 - DNA, 24 bp, Artificial Sequence
  Synthetic
gctgtgacgataacgttgtagatg

SEQ ID NO: 321 - DNA, 20 bp, Artificial Sequence
  Synthetic
ggacgatgggcatgaaactg

SEQ ID NO: 322 - DNA, 20 bp, Artificial Sequence
  Synthetic
taggattactgctcggtgac

SEQ ID NO: 323 - protein, 20 aa, Artificial Sequence
  Synthetic
CCAAATAGGATGTGTGCGAC

SEQ ID NO: 324 - DNA, 26 bp, Artificial Sequence
  Synthetic
ccacaaagacattggaacactatacc

SEQ ID NO: 325 - DNA, 24 bp, Artificial Sequence
  Synthetic
gctgtgacgataacgttgtagatg

SEQ ID NO: 326 - DNA, 26 bp, Artificial Sequence
  Synthetic
ccttatctgcttcctagtcctgtatg

SEQ ID NO: 327 - DNA, 20 bp, Artificial Sequence
  Synthetic
ggacgatgggcatgaaactg

SEQ ID NO: 328 - protein, 532 aa, Artificial Sequence
  Synthetic
  MISC_FEATURE (1)..(1): optionally absent
  MISC_FEATURE (3)..(11): optionally absent
MEQKLISEEDLQPWHGKAMQRASEAGATAPKASARNARGAPMDPTESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHVCTQNPQDSQWDRKDLGLCFDNCVTYFLQCLRTEKLENYFIPEFNLFSSNLIDKRSKEFLTKQIEYERNNEFPVFDEF

We claim:

1. A multimeric assembly, comprising a plurality of oligomeric substructures, wherein each oligomeric substructure comprises a plurality of proteins that self-interact around at least one axis of rotational symmetry, wherein each protein comprises:
   (a) one or more polypeptide-polypeptide interface ("O interface"), wherein the one or more O interfaces comprise the amino acid sequence of SEQ ID NO: 1 or 4, or wherein the one or more O interfaces comprise the amino acid sequence having at least 75% sequence identity along its full length the to the amino acid sequence selected from the group consisting of SEQ ID NOs: 3, 7-9, 20, and 304; and
   (b) one or more polypeptide domain that is capable of effecting membrane scission and release of an enveloped multimeric assembly from a cell by recruiting the ESCRT machinery to the site of budding by binding directly or indirectly to one or more ESCRT or ESCRT-associated proteins ("L domain");
   wherein one or more protein in the multimeric assembly further comprises one or more polypeptide domain that is capable of interacting with a lipid bilayer ("M domain");
   wherein the M domain, L domain, and O interface are not each present in a single naturally occurring protein, wherein the plurality of oligomeric substructures interact with each other at the one or more O interfaces.

2. The multimeric assembly of claim 1, wherein at least one protein in each oligomeric structure comprises one or more M domain, or wherein each protein comprises one or more M domain.

3. The multimeric assembly of claim 1, wherein the one or more O interfaces of different proteins in the oligomeric substructure orient the plurality of oligomeric substructures such that their symmetry axes are aligned with symmetry axes of the same kind in a designated mathematical symmetry group.

4. The multimeric assembly of claim 1, wherein the one or more O interfaces in each protein of each oligomeric substructure are identical.

5. The multimeric assembly of claim 1, wherein the one or more M domains are capable of non-covalently interacting with a lipid bilayer.

6. The multimeric assembly of claim 1, wherein the one or more L domains are capable of non-covalently interacting with one or more proteins in the ESCRT pathway.

7. The multimeric assembly of claim 1, wherein the one or more M domains are selected from the group consisting of SEQ ID NOs: 52-15 1 and 280-300.

8. The multimeric assembly of claim 1, wherein the one or more O interfaces comprise the amino acid sequence having at least 75% sequence identity along its full length to the amino acid sequence selected from the group consisting of SEQ ID NOs: 20 and 304.

9. The multimeric assembly of claim 8 wherein the one or more O interfaces comprise the amino acid sequence having at least 85% sequence identity along its full length to the amino acid sequence selected from the group consisting of SEQ ID NOs: 20 and 304.

10. The multimeric assembly of claim 9, wherein the one or more O interfaces comprise the amino acid sequence having at least 95% sequence identity along its full length to the amino acid sequence selected from the group consisting of SEQ ID NOs: 20 and 304.

11. The multimeric assembly of claim 10, wherein the one or more O interfaces comprise the amino acid sequence selected from the group consisting of SEQ ID NOs: 20 and 304.

12. The multimeric assembly of claim 1, wherein the one or more L domains comprise a linear amino acid sequence motif selected from the group consisting of SEQ ID NOs: 152-197 or 305-306, or overlapping combinations thereof.

13. The multimeric assembly of claim 1, further comprising a packaging moiety present in one or more of the proteins.

14. The multimeric assembly of claim 13, further comprising a cargo interacting with the packaging moiety.

15. The multimeric assembly of claim 1, wherein each protein in the plurality of proteins comprises or consists of the amino acid sequence of SEQ ID NOs: 227-269 or 317.

16. The multimeric assembly of claim 1, further comprising a lipid bilayer enveloping the multimeric assembly, wherein one or more of the M domains is bound to the lipid bilayer.

17. The multimeric assembly of claim 16, further comprising one or more transmembrane protein or membrane-anchored protein embedded in the lipid bilayer.

18. The multimeric assembly of claim 1, wherein the multimeric assembly comprises a cargo, wherein the cargo is not bound to the multimeric assembly.

19. A recombinant polypeptide comprising (a) a polypeptide domain that is capable of interacting with a lipid bilayer ("M domain"); (b) a polypeptide-polypeptide interface ("O interface"), wherein the one or more O interfaces comprise the amino acid sequence of SEQ ID NO: 1 or 4, or wherein the one or more O interfaces comprise the amino acid sequence having at least 75% sequence identity along its full length to the amino acid sequence selected from the group consisting of SEQ ID NOs: 3, 7-9, 20, and 304; and (c) a polypeptide domain that is capable of effecting membrane scission and release of an enveloped multimeric assembly from a cell by recruiting the ESCRT machinery to the site of budding by binding to one or more proteins in the eukaryotic ESCRT complex ("L domain"); wherein the M domain, the L domain, and the 0 interface are not each present in a single naturally occurring protein.

20. The recombinant polypeptide of claim 19, wherein the one or more O interfaces comprise the amino acid sequence having at least 75% sequence identity a long its full length to the amino acid sequence selected from the group consisting of SEQ ID NOs: 20 and 304.

21. The recombinant polypeptide of claim 20, wherein the one or more O interfaces comprise the amino acid sequence having at least 85% sequence identity a long its full length to the amino acid sequence selected from the group consisting of SEQ ID NOs: 20 and 304.

22. The recombinant polypeptide of claim 21, wherein the one or more O interfaces comprise the amino acid sequence having at least 95% sequence identity along its full length to the amino acid sequence selected from the group consisting of SEQ ID NOs: 20 and 304.

23. A recombinant nucleic acid encoding the recombinant polypeptide of claim 19.

24. A recombinant expression vector comprising the recombinant nucleic acid of claim 23 operatively linked to a promoter.

25. A recombinant host cell comprising the recombinant expression vector of claim 24.

* * * * *